United States Patent 11,180,807 (METHODS FOR DETECTING A GENETIC VARIATION IN ATTRACTIN-LIKE 1 (ATRNL1) GENE IN SUBJECT WITH PARKINSON'S DISEASE) - sequence listing, part 51

SEQ ID NO: 786 - DNA, 429000 bp, Homo sapiens
ctcattttcatatcaattggcagaaattatctttattagaaaaatgaaattttcctgtatttacatttttacaccatatgaccgggcacttctgttgcctcaggagttatatacatatcagtttgcacacgaatttcaatccccattccttaaaacagttgataacacattgaacaaaattaaaagacatactacaagaagacaaccatagtatatacttcctctatcatagaaaggtgttaagcaaacatataattttgtagctatgcttggaaatatttaatacacttattagcacttcctcatgcagtggattaaaacatgacagatataaactgctgcagttgatcagtgaacattaattcccaaatgaagaccattgcttagagcagacagcttgctttcagctccaccatacaagacatcaagtcagttctgatgtgggttttggattctgtttgaatgtagctgtgaatagaaaccctctgcatatggagttcaatcctagccttgttgggttaaaaatggactcagacataaacctggatagctgcttaattcaataactttcttgcaggcaatgaccagcttgtgtattatgcaacaagtcatattattaatacgtgagtgaaaaatgaatcatttatcctctttgagaaggccattatttataatttttatgatctaattcttattcaagctaccaagaaactcaccttattctttctgaacattcagcttgaaatatatatactatacataaacatatacacataaacattctggggtgatataaactatggtgaattctgccaattaattcagcaggtttatgcttttaaatttgttttggcaggggaatgaacaagattaagattcatagttaaaaacaactggtaaagaaatctttggggaccctcaggtttggaaggcatctgagccacatctaactatgtcactgctgtgtcaagcagttttctgaattttctatgaaaatgttattcttgaacttatatcttaagtaggcaattagcatcccttcccagtgaaaaatttggggaacatgaatgttaaaagttccactttcatcttttcaaattcatcaaaaatttcaaacaagatcacctggatttggctcaaattagaggcctgaatcttttgtttttaaactgaaacatttacgtaagtggtcatggccccagagcttttctacaaacttaataaactaaagatttaaaaaaatttaaaaaagattttaaaagtcaatactgttcattcacttgaattagcttgactgagaacagaaataattaaataagtcttagatggctaatgtagaaacttcgattgaattcaaaaggctatgattgtttttcatggaaaaaaaaagacaatgttttcgtatttctggatcttcgctctttgctcagttatcaatagtctttgatttgagccctttaaaacttgaaacagcaaaatgtcagatcaatgggaagcatttaaaatgccaaagacaaactcatgtttgctggagaacaattaacctcattaatttgaaaggcagctgtggtattggctatgagttatgttaatatcctattgaaggttcatcttaaatctttcctaaaggtgtgaaagagaattaactggaagaggtcatgacccagggctaatgaagaatgttctaggattgcaaaaatgcaaactcattgtttcactgacatagtaagtaagagaattatgagtgataatctcagttttgtcttcttcgtttctgcagaccgctgacactttatctgaggaagttaatctgaggaatgacttcattttaagcaatttagttctggttccctggagagttgcatgctttgaaatacaacccccagagaagaaatgctattggtcaaatcgttctttggagtgctccatttctgcatagctcaacattccaaggagaacatggtcacgcacttgtagacccaacaacaggatctccaaataacaaataataatctttctgtcttaaaaggctttttactgccagcttgaaagatgaaaacagctgagaaatttttctcatagactagcacttaacttgcattaagttagctaactctccagagaattcatggagactcccagaaagacattccttcaaatccccgctagtgtcctcatccatcaaatgggcctaatgcacccctcacctctcagtaaatataaatgccaggaaagaaatgtggcttagaccatggagaggggggaatgcaggaaaggcagtgtgtgctcaggggcatgcctgcaggatatgttaaacattaggccattctgggtacctataaagcccggtggaagcgttccagttcaacactcttcagtgggacagaataaccgtcattatcctaatgctaagtgagccgggaattatctctaagacaatttggaaaagaaaaaaaaaaaggaacagaccaagaaggaaaacaacaacaacattttaatagctggtcctcaatcattctgactaccaaagctctccatcattcatgcagaaactctatttcctattccctgtcccacctctgaaactcattccatctgcctggcaaagataaccaaacatagacatgaaataggaggaatagtcaacttgcaaataatatcacctctttgaacatgggtcacaatatttaggaggactttaatggagggtcacatggctgtgtgtgtgtgtgtgcatacccacacacatgagagcatgtactatgtatatatgtttaatggaattagccctgatgttgactgataaaaagatgagacattaggaaagagatatttaagattaggcacatgctaagtagagaaaataactccccagaaatttttttaaatgctaagtgcaagcatatgaaagggagacacaaacagtgttcaagtctcagaaggaactatgaacagaggtgagatccccagaagttctccatacacacagatcaggcaatgaggggtaagaccctaacagacttccctgtcacagaggctgatactcaagggtatatgcccaggaacctcaaaagagcacacctctctttctgacttctattctgacctccctggaggagaccaggcactttgaaaatatgtctaacgttagggatttactagctaattctagttgctgacgaggttgagaaaaacctgagcctcagtttccttatctgtaaaatgggagcaatcatatttatatcttaaggttgttttgaggatcacattctaggatatgcctagaatatcgcctacactcaatttagatatattttgatattttcaaattcaggtgcagatccatggcaagtacttgcgataagcagaaaatgtaacattccaagaatgcacagaatgggatagacagagtgacaaaagctccctctccacctcgccatccttcctgaaatacacctctattccttttgccatctctttgccccgttttctctctagggaacctgatgctttctgtcagccacagcagtaggcacttggaacttgataaagaattttccctctatgcttccctgatacattcataccctggtgtatcagaagggttcttcaaatgtcaaaaacaaaaccaaacaaaaaagctttagggaaatgcttcgtctttttacatcatggtctattttctaatcctttggggaattttttcaaccttttcttgaggcacatgtcataatgcaaggctgggaggaggcatgatttggcaaggactggagaactggttggaaccagacaaaagccttcctgtgcaaaaatgtaggagtgtgagtgtgttcacctggttagcagctcctgggtctcctaagtccattatttgaagattaaaataaatcaactgcatttccgggaccactaactctattctccggagttacttaaaggtttagggaaggactttttttttttttttaaaaaaggtatgctcatagaatcagattattttttttttcctggctacaactttagttgtcatttctaatttttgctgtttagtctctgtttgcattgcatgggtccttggttatcctttgtattagagaactgaacttctaaaccataagctacttatgggaagagactatattttctatttattttgcatcccctcccccacaatcccaaactggctttcaaaataaagtggacattcagtgaagtcctattagctggtcaatgtgcttggttcttcctcaatgcatgatacatagacctcaattatttcaatggtcactgccagccttttatcttcagtttgaggttttaaacaatatccctgttgatttttcctaaggagacggtctctgagaaaagttttctcttctaggaactttaagacagggattgtgagggagtttaaaggaaaaccaaattcaaagaagcatgggtaggtctttctggggcaagtggcaaaaacaaaaaacaaaacaaaacaaaaaccagggcagccttatggggatctctggctcttattccagagctactcaggagtttccccttgaaagaaacctagaaataagtcagcccggtcagagaatcgagccagaaattgaaccatgtcttggatctaatcctcgctctgatactctctaacttgatgatcttaaacaggcaactgcccatttgtaaacttcatttttctcatctctcctccccttctcctaacttttggtgtggttctacgaactctatttttctaagacccttctgggcaggcacttctagctaatactatactgaaagtactgctgggcacagaaagagtgcaggtgaggaaagaggataaggaatttaaataggaaatctatgccctttgatgtgtttaaggaaatcacacacaagtccatatcggcattgtcttcagaagcaaatgcgagcagaatatattctatacccctcatcccagagttttgttttttaaagaaggggccaagaacgccaacacccatattctacttaggctctgtcatcctccctacaactgagattaaaaaaatatagtgccctctctacagaaatatcctcccataaaaataaccagaatgggttttccatgtgttaataccatcatcaccatttaatttttaacataaactttacaatatgtacaattttatttggataatacacttacgtgtgaattgtagaaatcaagcatgtatattatatacatgtgtacacaagcagttgtattcacaggataagtgcatttgatcatctctgatctatatcaagtggcaagctgacctcatctgatacaattagatatgaacacagtacaatgtatagggattgaatgggaaacagtaactgcatattgggagaacttttcaagtatagaccccacagcactttcaaccctgttcaccaaaaagagatggggtatctggaaaggtctaattttgtctccagtgaaaataaacagtacttttggaaggaaaattgcctttacatagaacccttcactcattaaatatcaagcaacacatttagcttccacctactcaaacttctttttctttgagtccaatcatgtctactatagccatggttaatacaaacaggctccatttcagaaacaacgcatgtccccttttcaaggattcatgcacaacagctatgcacaaagaaacagtacaggaatgtgcataatgttaacgaatatatccagctcctctgtaaggtatttagagttctcaaattagtgtttatttaggtcttaaaccgcaagggatttcagtacaaggtacttatttatatgacaactgattattaaagctgcactttttagatttaaaggagataaatttttaatcaccatttaattaacatcaacattttttttctttttcattagcaattctatttgcaaataattcagggcatttgtcatttcctgtgaaggatgcagaatattaaatacacatcagtggtcgacatagcaaatagaataaacaatgtgtgactatatgacagctgtggatcttttgactaattaactgccttggctagagtcccatttaagtgaaactatttcatttgtaaacaaggtgtaattttctatttttctccccagaaaataagcgtgaaatgatttgacagattttgctgcaatgtgtgaattttaatgctttcaccagaaaaactaaatactcagactctctggcatcctgtgaatcagggaagagaaaatcaagagtaatccgtggatgcccagtcatggtgctggctaaaataacgcagagagatttgcagaggacataacagtaatgagtggtgagattgtgagattataatcctgcaagtctctctggcagaaagatagacctatagggacttgccagctcagagcattgaaaccataagtggcctaagaacctgcagatgtaaggatgatgaaacccattttccagaagcacaaaggtttctcaagtacagtttatgctctagaagactctcttacccagagtattttaaattggttgcatgtgcgtgctattacccatggacagagacccaaccgtttgcattcaagtgtacctatctgaggactagttgggtccttctcaagtggggaaaaccaattagaattaacaaaatatcattatggatgccagctctgacttaagccagctgaaactcaggcatttgtgttcagaaatttgggctccttgacatcaacaaatctaagaactcagagctgggatatgttacgggaatcttctgtgatagatctatagtctcaggcttccaggcttcctatttaattcttgttacttctcatactgtgggttccatttaccactggacgttacattcctgatattctttttgcaaagactgaactgacttagatgacctttgaataactctacatcttttccttagaaattgaccatctgatcagtagttgattttttttttttttttttttttttgcttgggatcatcacattgaagagtcattgaattagtagagaagggataccataaactttgtgtagcataacatttctgattatttatttgaaaaaacacttcggtcagtgaaaagaatatatatttttttcacaacattactgttgattcttccaaaggccacgttttcagtttctttatccagagatgtatggggttaatagcagaaataatgctgctgttaggggaaggctttctgaccgatgaagtcagtccaagtataactctcactctccctggaggtctctgtggcatttggcagccccctgggtttagaggacaccagaggaagacagaaagcctctttggcttgacgacaaatcactcttctgtattctgggaagactttttaattcattcatgtcaaaacatcccagactcatgaggaaatggaggcgatccttgctggggtggattaaggtctggaatgcactggaagggcagaaggtagaaagggctaaaaggctacacagtcatggagattcagatttaggatcagatgttggggtgactattctgggcccttcgatccaggcttctccatggctgggtcttggggcagcagaggtacagcatccgggaaataaaatgtcattttcaagcacatgcatccccagcacctagtcagccccttctgcctttcaaaaatgaaaggaagctcctctcacccactgcctccctctgtctccctatgattgaccctgaaatttattgcaaccacttttcattataggaacactgtaggtcaggtgtactttcccaaagatggagctattccatgcatccttgagctttaagggaatcatccctgacacttgcccacatgcaagaaaataatacttacaaaacagaacgcacaccatgaggagaagaaatgggataatttttcaacctgccactttatccctttcttcaagaatgtaaagcagaatgcaggaggaaaccaggaaatggccaggcgagtctacattagcttagtgtttccgtaatggcccaaaacagactgaggtcttctgcaaacactgatggctagttatcccaaatacttcaaaaatattcatgtacatgaaatacactaattaacagagtagaactatataaaaggtttagttaatattatttgctggttttatgatatttaatttttaaactagaaaatcctgatctgagaaagtgtcataacatagcaactatcttgtcgggggcacttgtttttgtggcaggcactgtgctaacaggctccccatgcataagtattcccctctctgtctctaacttaaaaaaaaaatggatatcatttcatgtcatatatgcacaggtttgaggagaataagaatgggataatgcaggcgactcagaaatgacaaatactttgaggaatttttcctacatctctgttggtgctatgaagtggtttgccaccaacagagagaataactcagaagggagaaattgcttgtctcactaaactgtatccacagtttggaggatactcagggtagatccaagagtgcctcgtgttttgaaggcttttgatttgaggagtttggggtggaagtgagtgtccaacagaatttctggatgtgaaggaagataaacctaaaaccatgctagccttcggcagacagatggcattgtacttcttacagatcacagtacacatacggctgttggtgcatgtcaccacattaacaactctgggaagagcgatacacagctaattggacaccaccatggctgtttggaaacggaacgagttatggttactctgggagggaaggggtaacagatactatacaaccctgagtcatcaccagaagggaggaaatgcaaacttacgtacataggcgtcttcgggataaactacaatggccactgtgtcacagacagaagatccacacttagatctcggagacataaatgtgttagtttatgcagctctgaacaagaccatcgaagccgagggtgagagaaacacacatcaacatccaaagagattcctgtagctctccccacctgagggtccctcgggcctttggctccagatgtgtcttggaaatgaactataatgaaggtagcacagtcatcacgaacacactgatttgctattctttaggggagcctggagttcttggggtgagcctgggctgtgatggaaggcataacaagaaagctgaaactgttacgagccaaacttcctaatctcttgcacatgtcaatcgcactacagtgcagatgcattcttaactgtttttattttgtctgtgtcaggtttacatgcacaccatattgcttattctgtattagagaaaccattaggcatttctgatgagaaaattacatggtgggctgaccttaatggaatttggaatataggaaatcataacatcaccattggcatccaatgcatcattattgccaacatacccagtaggcatgtcccggagacttgcccttatgtagttagttatttttggttaaggactcacctatctggtgtctgccatgctcagcacacacctcacaagattccttgagtggaagattatggcatgaagccgtgtgcaaaagagccaacaacaacaacaacaaaatacctccctacatcttcttcctcttagcagggcactattggacatccaacatttaccctccagaacattggccattacgtatatttccctatagataaaacattaatggaagatttttaaacatcagattcgatactaggcattttcttgtacacgcgtctattgctgcaggaatttaaaaccctgggggtagagtacatattattcttatttgcagcataaggcataacatgctccgaaatatacacatcattgtggccccgactgtccctggaacagtacgatgccgttgacctcaaggacgaccgaagatagctgtcattcaccgcctgggatggcaacgagtgtttgtaagggtccgaggggcatctcccaataaccaagcgttggtcatccctgtgggagtggaggaaagggttatcggaggtgtggtctggcaagagagacttgctcctcttgctgtcctccagaccttgggggaaaagggagctttttttccccgagagtttgcttgaggggacactaaacaggctgccgtaaaaatttccctccagaagccgttccctgtccttgaggcttatgctccgggagggcctgctaaggtctagctccctaggtttgtcgacaatgttatcgtaggaatgctgacggctaatccttagcttgttcttttgtaattgaagggcattgttctgtgcccagtcctgctggtagacctgctccccggtggctgggttacctgtctcctgaagcatctggtcttcatcgatgtcatagaggttccccatccgcaggcaggcatcgcacttgaagggggacctcatggtgaagtggcctgaataggtgggcatgttggaaaggcagcttctgcagtgcgtggagttctgccggtatcgctcgctggtctcactgtgcggggaacccttgtctttcaaggtgaagtgcttggagtagagtttatactggtcgttgttggaaagcccctcttcattatgcaaggggttccggttcattggcagcgtggagtcccccttgcggaagttttcactgggatcctggtaggggtccgggaagtccacgttctcgggcagggtcacattttcaacaaactggggtggatctaagtggaaaccaggctccttctcaccatctatagtgtagatcttgtctctaggggagcttgatttggttttcaggtaggtgcgctcgacctcactacagtccttggggtatttggaggccactgaccttttaaagttgtccttggttttgtggttcttactgttgtcaggttccctgtggcacgtggcccgatttgacgtttctgaaatgtcagagtgggccatctcttctggaagatacctagggctctttagggagtgggtcctattctctgctgttgcctcatccctctgggagactggattctgggatagtgaatcctggcgtatggaatccacggatttcttccacagctgccggggtctagagttcgctttggattctgtgctcacggccacctccaccgtgttagggttggactcattgagagtaagaggatgttgtccctggaatacatagttattgaggttatccttctgccggttggccacaaatgtttggagttcgttcatgttgtctccaaaaatgctctctttcccctgaaaggacctgttgtctgagtacatcaaattccccttatctgaaaccatgtccatgatgagggaacctctttggatgaagtcagcagctcttttgggtgagtccattcttgaggagttcatgttggacatgctggaaatgtttttggctgaccggaggagttttaacatgttgctctgggatcccgtcagattgaagtctggagacttcttcttttcttcaatgtgcactccatgaatgcagctgtagatgccctgtaggggagcaacataaagcactgtcagcagcagcagcagtgaacatgaaaccactttgcacttgaactttacctgcaaaggtgagatttgcacttcttgcaggagccctggagaaacagcaaaattcagtctgaatcctgataatgtctcttaaaggtatgagacaagttgcaaagcatagggtttatcttattgctctggctcaagattagctgacacctttgcaaagagtcacacatggagtttgagaaaaggtatcaaccgatgctcatacaactgtcaatgcctcagtgtctccaaagtggcatataagaacagataactgagcctcccagcacccgggtcaccaatccaagctttcattaaagtttcccagcatcatctttgaaagtttaggcaccagagagttaactactgacaaacacagtcagcatgaaaggatcatccattgttaattcttttctggaattacccctactcttatgcaaaagctaacaatcaaagaatgtgtcctaagtggccaatcagaaaatctcttctccatgcacacattgattcatctaaaggaaggcatgaaattcatgtgaggctcatcatactctttgagggggggatagatgtggatgcttggatagaaggagttgcagacttaccatcatgtgggggtgtgagcctatcagtgaagccattgcagtgaaaagtagagcccaagagatagagaaagacatggtttaaacccctggagccactcccttgaacttttttacttaatcgactcaatctattccttgtgtgtttgtttgtgtgtgagtctattcaatgtagttagaactgggttttagttactagtcacagtgaagagttctgatgacacagtgacaccgcctttaaatccatccagggaactgaatgacttaagggctcctgggcagcccaaatacaagcacctccatctatatgtcttctcattttctactctttctttcttttagaaaacaactgtttacgttcacttaaaagtagctgttcaactgttatcaagggaagagcccttgattcctaccacaataacaggcaaaaggacgtctggaacattttgatctgtggcttcccctgcttctccccactcctaccccagatttcagcagccgtacctacaggaaacagtcagatcaaggctgcaggatttgacctggtcttcccaaggctgacagggagccaaactatgaaggggtttgtagggcagaattggcagtggctgctgactttggcataaactacaggaaagtaagtgtgattaactgtggactctgataatggtggctccatcggtcccccatggtggggacaagctcaccctgcagggatgctcacggaactgtgacagcctcaactcattttcactgctacatttttcttgtagtagacagtctctccactccagccttcaaggaaccgtaaacacaaaagcctacagttgcaagtttgagctgctctttctctgatcctctccaccccaggcttcatggttggtgaaggccccctgaggctcagggcactggcattacatcctttcctgcattcctgcaaacttatctgtggtctccttctatatataatgtgtggttggctgtttgtcctgccacaaaataacatctgcccctgccatcactgcttccagagctgctggagcatccagactgtggatgtggaaatcttacaaatgagccactgcgctccagcctgggcaacagagggagactccatctcaaaaaaataaataagtaaataaatcaaatcaaatcaatcaatcaatcaataaaagcacattgctcccataaaacttggggtccttctcccctagggatggagaggccaaagttcaaattctagatgatcaagggactccaccaacaatgcctgccctgtgctgcccagtttgccttccattcccatcctttggaaaggaagatatggatttacttcatttcttaaaatgttgataaatcaacttggcttccttagcagtgttttagatagatagaggaaatgctcttccaaaaacaagcaagatttagaagtaaacgcaacagtgtgcatttgtttggtgctaatcccagaatcatttggatatgaaaagcctttggtaattggctgggagaattagcttaaagttggcataatacctagctctatgcacgtacgttgttatttttaagcaatctatgtgtttagatgccatcaagctaattaggaaatatgtatttgcacagaacccgagtttggagtgcaagtgaatggagaaaataaatcttcctcactaaactaatgtgtaccttccgaatctccacagttcttgaaactagcaaatgttaagaatatacaaatctgttttaaagcaattagttagctttctcagtaaacaatagcatataaaattagatttttatttatttatttttattattatactttaagttctagggtacatgtgcacaacgtgcaggtttgttacatatgtatacatgtgctgtgttggtttgctgcaattagatgtttttaaccaaagagttttcaccatttttcaaatcctaattaatgaagttcttccaaggcaaaaaaacaaacaaaaacaaaaaaaaacacaaacaaaacaaaaaaacaaacaaaaaaacaaggtgggcaaataagagagatgagtggataaatagatggatgcatagatggctgaaacgaatgaatggacatatagataagaaggtagatacatatgtattttgtgctgttgtttatgttgagttgaaggtaaactttgttttctgcttgatacgtgtgcattttcttctgttactttacacctgtgtttcctttcatgtgctattgcattccacatgctctttgtgttttattagatgtgtatacatattccatagcattgcaagtagattttgttttgttgggcatgttctgttacaatgcatacacaaattgtaacatcttgcatagcagcattagtagtgttatacagcatacctgggtgctagtgatgggagccacaggctggctctgtctggcccagtgtttttaaatttttttttattttttgtttttatttttttgtgagacggagtctcgctctttcacccaggctggagctggagttcagtggcgctatcttggctcactgcaagctccgcttcccgggttcacgccattctcctgcctcagcctccggggtagctgggactacaggcgcccggctaattttttgtgtttttagtagagaaggggggggtctcaccgtgttagccaggatggtctcgatctcctgacctcgtgatccgcccgcctgggcctcccaaagtgctgggattataggcatgagccaccgtgcccggccaaaaaatttttacatggaattagttactaatatttaaaaatggaaaggtttctaacaaaatcagatgacattttctctttttaaaaaactagaagacctgataatattgactctacattcccataagacaatactcagcaggagttgaggatggctgccacgctactggtgaggtaaacatcatgcaattggccacagtcctcagtattccctatcgttctctcactttgatactgaggtttagctgccgtttcacgtcatctgtgctatttttctcatgtcccgcctgctgcacccactcccgtttcctttctgccttccttagtcatctaagtttgcaacacctggcttatgaatgcacaaaatctggatgctcttgtgacatgcccaagaaaggctggtaaggggaggaagtgcagaccccactgagacatcaagaacccaagcgcttttctaaacctgcttgcagtgcaagaaagtagccacccggtgtactgaccctgctgatggagaagagcaacccaggccggtcggagcacacgcccgtgaaacagaagcgcagcttccagtagaagaggtgctcccagatgaaggtgatgaggctaagggccatggcggcagccagcatgtagaatacgcccgccatgttgtcaatgtccagctggctgctcatcacctcgttcttctcgttgtggcagatcccagtgagccacagggtctccagctcctccatctcacctggacagatcacaacattcacaggcagtgaggaccagaacatgcactttggggcagacgcttctgggtttggaacagacgatgtgcaactcacagctatgtaaccttaagacaagtttctgagtttgctgggtttccatttgctcacttcttgagtgaagataataatgattacatagcctacctaatattgttgcagtgaggacaaaatttatatataaaaatagagaatataatatatatatagagagagagtatagcaaacttattctctattaatatgtatatatattatatattatatacatatataatatatataacttagcacagttcctggttttgttttttggagttttgtcttttttttttttttttttttggtcattattatgtttttctgaccttgctttcccttacccctgcccccaatacccacccaagcttggaacaagacatgggaataaaagggcagaacgtgacaatagaaagacttcattgcaattctgacttgatcatctgctagctgcatggcctcggagctacagttatcctgtctgtgaaataggcataataatagaacatacttcctagagtcgccatgaggattgaatgagatgagaatgtataaaatccctaaaggacccagatcatagtaagttttcataagcagtatgtttgctactatttactgttgtgaagaaaatgcctaacacagtgcctggcctgtggcaatcctcaaatatgtgtgtttctttttctctctctctttagaacattcaggattacttagaaaagtcacacatgagcagcatacttagggcacaaaactttaattgaaaagagacatccagctggctctgaatggccccttgcaaactaaactatacccaccccccaacttcagtaggcaattaaagaaccaggtggttttttccaatggggggaagaaaagagtaggcatgcttagaattattctgtccctcttttatgtgcattttatcctgttgccatttaggagaaaattctctgatctatatgtctagcaattatactgtctagcaattcactaaactatggcacttagactatgattcagcctttaaaaatgatctttcaaggacagtaaaaatcaagatgtgtatgctaaatgaaaagtatgactatattttatatgtatatacatgatctctaagatgtaatggggacatgcagagaaaaattaacgaaatactccaaatgtttatatcaattctctttgaagaagtcaatcaaaatgatttaatattggtctttttttaagttatgtgaaattagcatgtattgtttttggtttgttctcactcttgaatgatatggctgaatataaaaatcaaagttgacaattatttttccttgaccttttggagatgttaaattttcctctgatctggatggcagttgttgaaaagttggctaatcatctaattgtcgttactttctatgcaatctatattttctctctagttgcttttgagaatttcactttgtctttggtgtgaagtctagatgtgggtttgttttattggttcggctctggacttagtacgattcttcaatctgaatacttagaactttagttctggcaaaaattcacctgctatggctttgaatattacttctccctatcatatcttttttaaaaagttaatagattttatttttttagagtggttttatagttacagaaaaactgaacagaaagtacagagagttcccatatactacctctccccgctcccttcggttttccctgttaacatcttgcattagtgtggtacagtttttacagttcatttgggtaaatacctaggagcattattgctagattatacagtaagtctgtgtttcagctttgtaggaaactgccaaactttcttccaaagtggctgtactattttgcactcccatcaacaatgaatgagagagctcctgttgctccaagtcctcaccacccttttcattgtcagtgttagtgttagtgtttggggttttagccactctcatagggatgtagtgctagctcattatttcaatttgcaattccctaatggtatataatagtcccatctttttttttttttttcctgaaaactttaaaatactgtggaacttttcattctctcctctaggttatttaccttgttttaatatttgcattcttttttctctctgtgctgcatttgggtaatttccaatagatgtattttcccgttaatttattcttttgttggtaatatttagctttatgttttaattttatttattttaattgtgatattcatttggttcttttacagttctgcctgttctttttatcataatatcccatccttttgttatatagtttgttatataaagtttaaaagtttttaaaactttcatatatttaataattttaaacctctagtctttcagattactcccccccacccccaccttagttcttgggattctcattcctctgtttgctgtgtgttctgactctcatggtgggttacttccttgtgacgtctgtaacttttgaccatgagctaatcttctgcagaattattttccctctaagccccatgggactcccaagaacactaggctacagaaacatccctatagagagtttctgggtttgcttctgccatggttccaggaattttcaatgtatgagtttttgtatggaaaaatttttactttgattactacaccatttaagtagcatacatttgaactcacatgctcatttgggctttaatttcttactgacagcttcaaacagatggtaaacctccttgcattttcttcactttgatggacagagattttcctagttttctttttacagactaagtgactcattaaagttctcaaatgtattaaccagaaaaaaaagcatacatgttaatgagtttttttttaaaaaaataggaaatccatccctttccagttcctcacccacaaaaatgggtgctgatcaatcggttgtgtaggtaaagggatgagaagagggtatcttgattcaattccttttcttccaacagcctcccatgctttcgcacagtcacaaagtcatgggagactttgaaataatatctcactgtccaccaacactatctcaaactcatccagatttctctgcccaccatgtacctcagacctgcacggctgcttcctcttctcacaaaaacaccaatgccatccctttggaaatacaatgtgctgttgacgtcccccctccctttggaggtattttgttttgttttgttgagatggggtctcactacagtcgcccaggctggagtgcagtggtgcgatcataactcactacagtagcaacttcctgggctcaggtgatcctcccacctcagcctccgaagtagttgggacgacaggcacatgccaccatgctgtgctaattttttgtatttttagtagagacgaggtttcaccatcttgcccaggctgatgatctcaaactcctgggctcaagcaacccacctggctcagcctcccaaagtgctaggattacaggcgtgagccaccgtgctcagaccctttggagtctgggaggacacaaaaatgggtcttctcactatgactcatcagattcccagaacatcttcctttcggtgttgcctcaaaccaagccaggtttgtaagcctgtaaggagggcagtctgatataagaaacatcatctcgattcttttcaggatgtaaataaaaagatttccttctgccctttgcccaaacaatacctctttttagaggaaatcaacatggtaaagcagacttcaatttcaaaaaaaaaaaaaaaaaaaaagagcaaatgcacatttctcattaccaattacagcctgttccaatcattttcaaattaatcatttcctgcctcgtggccctctttgactagcgtactgaactgtagttcaaatactttcttatttcatttttaatttactcaagtatattgtaatctcctggagggagatcagggaccatgttttatggttttgatatttttcgtggcctgcagcacgtagtgagcattgaatccatattttctgtttctgtttcttttcttacatccccaggcttaaactgggcagcattgcagaagtgttcaaatctgtttagtgagttattctgccatataaatagaaggaatacaaagcaaaggggaacttgcagcgggcttgagagtaaaaggctgggaaatgtgcatcctttaggtagggtgaagcatcaaatgtcgtttttccaaggagtggctctatgatatttattctgctgccagtttctcctattaaaaagaggccgtgatctttgtcagtgtgatcttgtgaaccagagctgataaatggggcaattaaatctctttcctgaagcagactcattcttgctgggaacacacaagctaaatgctctcttgggaacagatggagcctgggaagttttggggttgcagtcaaaccacactgcctttgtctccccaccggagaggactggtccccatgtagcactcaaagccctctccttttgtgtttccacctcctccagtgacagtaagctcatgcacatttgcagaacttctttgcgcccatgggaacttgcacctgttcttcctatatctgttttcaggggagatgtttccagccacaagtatctctactaaccacttagttctgcaccatcgtgaggaaagctgtaagttcagtagaaggagcaaggtgtcaaggtcactcttttcctaatgctgacaacattaaaagacagagtaatagagtttcaggagtcaaccgtcagagagatgcagaatctaaaagggaacaggcaagggtaattgaggcagtgttgtgtgtgtgtgtctccaacttgcttccattccatttaaaagggaacaggcaaggataattgaggcagtgttgtgtgtgtgtgtctccaacttgcttccattccattccactggctgcttgggtcaggctgtaagaaggctggttagacaaaaggcacagacaggatgcagacagtggaggagtttctcccattacccatccacccactgacaaggtggaagccaggggttttatatttgcaaaaaggaatgaaagaaaattcaactagatactgtccagcaaattacaagaaagaatgtttcaggtagaaaacactagaatgagatataaaaggaagcacccttcccttaagattttggggagcacatccagtcatctggtaaggtctagatagtaacacagaggtattaatacactcaggtattaatacactcaatatctgagtcagacggcctgcattagactcttggcttccacaggtaccggctctttgatcatggtccaggtactctactttaatctatccaactactcatccattcatgtatttatttttctatttaacaaaattacataaaatagactgtccttcaggtactatactagagtttaaaaaaattaactcatgtaaacttaatatggcttgtctagtttacagatgagggcacgcaggtgcagagaggttaaggagtttgcttaatcactctaagcttcagttttaatatcgagcaaatgggagtacatcagaatttatctcataggagttttgttagaattaaacgatgttgcatacacacagtgcctggcatacactaattacaaaatcagtatttctggagatattattattgcctgaaatcagggaagctggggggtgggatggaccacataatgctctctgtgcccttctaactcactctatctatgattccaagaacgcaagtccagggagaaggttcagctctccatggagactctcttatatccaaagtaagagaaattagttctctatttgccctaagactcattctcagcacttccagaggaactgcagtttttgggaatggattttatagcaagcaatgtgactagccttcaaacttcccaagtacctctcccctgaggtcatttgtgaaaaatccattttgaacctgtaccctttaggctttgtccaaaatttgctgaaacatatcttctaaaatcagcttccacaggcacacgtctacatattttttttttcttggtttcttgccaaagcacctgacccaaggcagtgatgaaagatgaaaagagagagtatgtggttctgagaagctgagttcgatgttctatttcatgtctggtcaaggaagctgttgctttttggttttccgaggacttcatttgttttttttctttactcattcattcactcattgaaaagagaaaatttgtaaagcacttaacatgtggcaaacatctctgtattttcatatagagatgaattacagatagtctttggcctctaagagctcattcctgtgagagagacagtcatgaaaaccagtagttacggcaaaatgagatgattggatttgcatagggctggaggcaggaagaaacaaggagtgttgagatcagagagcagttcaggatttctgggaaggaagaagggatcaaaggaggagcccgaagagtagaagccagaatgctaagaacttgattttcattctaacaagtctggggtacccagggaacagcaaggccgtcagatgtacatctgtagtgaacacccaactattttcttagtggacccaaggttcttcagttgttgctcatgtttctccagtcatggccccctgattggaaatccagtgtctcctcacatacaataggaggtaagctgtgatgagtgagtgtgcaatgtctcattcaaattgcaaatgtgtacaatggtgctaccatgtggaggaaggtcaccagtcaactctatcctggtgacacagtcactattagagtcctgtcctgatttcagagtcagacagaagacgcagcttaagctttcctgttccgaggttatgcagtgactgggagaaacgcacttacaagaaactgctggcaaggattcattgtaaactgtcaccaatatcataacccattacagtctactctggatataccagctgcatggtatttgtgctgaaaacttggcaatagctatctttggtgtatagctcagaggtatccaccttcaggaagtcttccctgaaggcacaggaatgtaaatatgacgccatggtttcctctaccataacatcctggattttttttttttttttttgtatagaatttgtcacagtggaacgtaattgtcactgggaggtgagtttattcagggcagggatcttgttttattctccttgtacccccagtctgtggcacaggtcttggtacatgtggttcatgacattgcaccaactgtggataacacaaggctcctgtctccttgattagtttgtgatccacagatctgaggatcggtcagagcccaagacaggaagaagtttgagaagccccaggcaaaggggtgaggaatagattctgaaacccagaaatcaaggctggctcttgggcgagtatgttctcatcaaagatcccagcaatagagcctggtggtttcctacagggaacagacttccatctatagctgaaagacgtcagaaggttgttgctgctgatctcattcgggttcgctgtgaacaccgagagggtaactgaccccatttcaatcctgtttcatgtcttgcccaggggttgggtactttgggtttctcagaagcccgattggaattggaaatggcaaaggaacaacttttttatgggaaatctagggcacagattcattggcaggctcatgttctcgatgacaacagacttggtcattctgagttctgagttgtggtcctgcaattgaggatggcctgggggacacagaattggggccaaatcctctccttgcccagttgtcctgtagatgaaaggaagttgtgtatcagatttggggatgtggtctgtggccttggagcagagtaagatcagctagaccatctgagctttgaccttgagggcccaacttcattaattccaccatcttgactcaaagccatgtgaggcaagtccaccctcccagatgcagcagtgagaaactcattcctttctctcttccctgtggtgacccaacacccatgttgttttaaagacaaatttaaaaactctcaaaaggacaaaacaaaggcccaataaatctgacaaataagaaaaaaaaatgagctagagaaaaataagacccaagtaaccctgggttcagaaataatattctggagcctgtgacctctgttctcacgatctcagagggtcactgaactatttgccgaagtgaaaaaatacttttgatggtggtggtgataggaaatagtacaagattctggacacaaatagattgaatttgggagataaatattccttatttaaatgtcagaatattccatttctgtataatgctgagaagtcacaaaaccaaaataaaaatagggctaggcttaaatgtatccagttagaggcagggacaggctgtctttggcataaatgtttcaccgccaccttccaactgagatttctgctccatggatgaaacttgagtattgttaagttcattgctacttgtcacattgcaggatttcacaggccacgtgattagtcgcacaagttggatggagttgggggattttatgcacacaggttcccaaccataaaatctcccaactctggccgggtgcagtggctcacgcctgtaatcccagcactctgggaggccgaggcacgcagatcacctggggtcaggagtttgagaccggcctggccaacatggtgaaaccctatctctactaaaaatacaaaaaattagctgggcgtggtcgtgggcgcctgtaatcccagctactcaggaggctgaggcagtagaatcacttgaacctgggaggtggaggttgcagggagctgagatcgcgccattgcactccagcctgggcaacaagagtgaaactgtctcaaaaacaacaacaacaaaaaacccaactacaacttgtgcagcttcccaaccagtgtctctttcagaagaaaaattaaaaagaggattggacaataaaagattggacaactctatcaaacatcaaacaatacacatggtcataattttccattactggatgaagttggagagatacaattctttgaagtaagacggcagaaaccttgtaggaatccaggaaaccttattatataccaagcacttctggaatctgcttaaccaatctgcctcacacaaataaagacggtcaagctgacatggcttaaaaggcacatgcatttgtgagcacaaatgaattcatagtgactttttgccattgcatattttctcaatcaatagtcctcaaaatctgatgacttatcatgggaaggttatgaggactttttaatatcacaaaggagttcttgtgttttaaacacatacagatttaagaaaaaaaaggatagcaataacttcagatcccgtgctgttttgagagccactggctaaactgggtttccagtactacagcagctaacaaccctgccctaatgaccaacgaggggaagtaaatctgggtgtttacacgtgcctttcacaggatgcttcttttacctagtagacaacctcatgcctagttttcctatccatgaccaggggatctctcccaggaggaacttatttataactgctgatgcccttgcagctcttgtctgacccatgtccagtttatgtctgcctgatcatcgctctggcactggaagcccaaccttgtagtctccccgagggaaaacccagtctgcggtagttcctaggtcttcagatgaaaggtgcaaattcaatacaccaccatatagaaaataagctcaaagatttattacttacacatcctgggcagggagggtgcaatgaatcaagaggacagttttctgctcctgcatcacacaaggcaagaatgaagagtcagcccgagaaagagagaatgtggccaactagtggtacataaaagggaatagcgtgcgggtcactttaagtttgcaggcaaatgcctgaatgatccatttaaaggaagcagtgggaaagcatggagcctggtctcccaggttggggagatgcctctgagttcttatctctggccaggggcttcagccatttgggtgtgatgcttctcttgtaactccaaggtaacctatgctgtgttgctcagttctacatgccaagaaatagctcctcttttcagcaagtaaaattatctcactgcttttcagtttcttttttatcgaagtgttgtcaacaagttccttgaagctgtaaaatccagaagcgaaatggatcacttccatttgatctgtattccccattgcttagtatacacaaggagcttaatgggcatcggagacttagttgtggaatgaagagagaaggagagagtggaaaggaaagaaaagaggacagggaagagaaggaggaggaagaaaaaggggaatggagaaggacagaaagtgagaaataaaactattacagaagggaccctatatcagctgtcagaaccatccgtaactaaagcagaaggaagaccctgtttttctttccatagagggtaatagggtggtgtgcagggctgggttatgacttaggagagctctcagctcttcctttgatgacatcctcccgctccccaggtatggaggtgctcctctgacctcctctcccttttcccaagtctaaggcaccagatggggtgagacagtggccagggatgagtggaagagcacatgcgggtggcagagaagctagatatcaattctaactcaggaaagtaagtggggcagactccacagtcctctgcccccattgtactgacattaaatctgaggtcaggttacatgaaccaaggtcacaaaataaggcaatgttgatgttggggcaagaatctggatctctaaatgactggtggcaacagccaaccacacagccactgatgaagacacctagagttctgttgcacaagccagctttacctcttacagaaagtcgaaaaggagcacttgcaaattggagaaactacctgcactgctggcaggaatgtaaattggtttacattttcagaacactggttcaaagtatctactaaagttgagtagacgcgctctattacccagcaatttcattcctaggtatatttccaaaccaataagtgcctttgtgcacaagaaaggtacaaaaatatccaaagcagacaaaaactaaaagtgatgtaaatgcccatcagcagcaaaatggataaatttgtacgataaaataccacccagcaacgaaaaaaaataatgagctgtggttacatgcagtaatatgtatcaatgtcacaagagacatcaatgaatacatgttgtatgattccaccatttatttgaggatcaaaagaagacaaaaccaccccatggtcatggaggacagaatgttgattacttgtggggggcatattgactggcatgggccatgaggaagctttctaggatagtggtcacattttatagctcaatctgggtgggagttgcacagctgtacaaaaattaactggatattgggatttgtgcaatataacgaatgtatgtcatagtttatagaaggtaacaaatagaaaaaaacagtgagtggcatagtacaggtataagtgttcttttactttgggggttaagtgaggtaataataaggaaagttgaagaaaacagactttctaaaccagaggagagaaaaatacaaacttttttaagcgtgatatttctttacaaaaagagaaaatttctttaaggataaggggaaaccagtcatgtttagttaaattcttccaattgttggaattgtttcaaaataacatgtcacttttattgtttaagccagaggtcactaatctttttttttttttatggtaaacggccaattagtaaatattttcagcactacaggccatacggtctctatcacaactactcaactctgcctttgtagcacaaaaacagccatagacaatgcgtaatacaggaatgagtgtggttgtgttccagtaaaactttataaaaaacatgtaatgggccataatttgcagaattctgatttaaccaatcaaaacatgaaacatgaaataactttttatatttatataaaagagatagcatgttgcaccttctaaaatagcaaaaagaactgtaatgcctaatgctgctagatagtggtaaaattggtacattgatccactattactattactttagatggaaacaaaacttttttttctttgagacagggtcttgttctgtcacccatgctggagtgcagtggaaggaacactgctctctgcagcctcaacctcccaggctcaagtgatcctcccacctcagcttccaaagtagctaggaccacaggtgcatgccactatgcctagataatgtctttattttttgtagagatggggtctcaccatgttgcccaggctagtcttgaactcctgggctcaagcaatccccccaccttggcctcctaaagtgctgggattacaggtatgagtcactgcacccagggttaacaaaccttttgggcatcaatatgacgccatatatcaagactcctagagatctttagaaccagtaacctttaaattctacatctaagagtttgttgcaaatagttcaaaagaaaaaagaaataggcatgaagaaatttcttccatcgttatctatactagccaaatatcaaaatgtgtagcatttggaaaataatgtaatggtttctggtttaataaagatgatgacattttatgcaaaaaattaaaataattgtgaaagcagatagtatagttacataagaatgcttaaaatgtaataataagtgaaaaatcatggactataaaagtatatataaccaataattataattaaagaaatgtgtctgcaagtaacagggatcaggagataatacataaattaaaaacaattatgttaaagtagtagattggggtgattatatgtacagtcagccctttctgtatttgtgaattcaaatgatcacagattgaaaatattttggggagaaaatggtgtctgcactaaacatatacagacttttttttcttgtcattgtttcctaaaccatacggtgtaacaactatttagatcgcatttatattgcattaggtattataagtaaactagagatgatttaaagtataagatgtgcatagattatattcaaatgctacaccattttatatcaggaacttgagcatccacagattttggtgtctgtaggagaccctcaaaccaatcctccacaatactgagggacaactgtatatataatatattgcctttccaaattaaagtgtttaaaaaatatagactgagagggatttggggccactgtttatccatgccataaattttgcacgagcctatgtgacatcaatgtttgacttaccaacaagccattcattatatcttatttccactttgatggttctcttgacatttgactttctctggtttgagcaattcactgcttgtcaggcatgggcctggcatgctgaccttgtactaatcctggtgttggattgataacagacactaagattctgaatctcaacaggcccattagggaattcactgcaaatttacgcagattaaatcccctggagttttaccactgaggaagactcagtggctctccaggatatttatggatattatctgtttcttaataagtactgttccattattattccaaatatgtctctagttaaaattaggagggaaataaacaagtctaatttttatggtatcatctggtcacaggccaatggagaagcagttaagtcctttattgctaatctatgcttagaactgacatatctcttatttgaaaacgttgcatttctgaataaatggtttgccctagacagtttttgggtcataggagagtaagtgacttagttgttggggcatcagaatggttattaatgatcacccccttctgatgtctatatcatcagtgtattatctttgtgtatacatgaggtttatgtacatgcaaaagtcacccacatacgtgggagcaataatgaaatccacataaaaaattagactcaatcaacggtctttagctgcactttccccgtggtttcacatgagaccccgtctacacgtataaggaatcaggatagccattgcgtccaaatctagttccagatccgatttaatcgatagaagtgctggctcagtctttacccaaatgtggggttttcagttttgcctgctttatttttaacactgttattatagtcaataaatgaaaatgaaatctttggaagcaataaaggctttcatgtctatttcgatccttcctggatgaggaagcttaacattaaagcttatctgactacgtcttccattcatagcctaccctcatatctcctatgttctttattgtggttggcatgtggactaacgcttagaagtgccaaaccatttatgcctctagttttcacaatcaccaagggctctgtgtaaacccaattagaagccctgagagaaagagaatgaataaaactcagggcaaagattcaatatcatggaccccaactgagtgattggatggcaactgatatgtgtactcaacgtctgccaatcacaggataaaatgtttctaaatggtaaatattgttactttaaagagtgattcttaaaccttatggatggagctgaagaccattattctcagtaaactaacaaaggaacagaaaaccaaataccccatgttctcactttcaagggagagctaaaggatgagaacacatagacatatagaagggagcaacacacactggggcctaatggagggtggaggataggaggagggagaggatcaggaaaaacaaataatgggtactgggcttaatacctgggtgatgaaataatctgtacaacaaacccccatgacacaagtttacctatatagcaaacccgtacatgtacccatgaacttccaacaaaagttttttaaaaagaattatatggctgggtgtggtggctcacagctctaatcccagcactttgggaagccgaggtgggtggatcacctgaggtcaggagttcaagaccagcctggccaacatggcaaaacccagtctctactacaaatacaaaaattagccaggcgtggtggtgggtgcctgtaatcccagctactcgggaggctaaggcaggaaaattgcttgaacccaggaagcagaggttacagtaagccgagatctcaccactgcattccagcctgggctacaagagcaaaactctaacaacaacaacaaccaaaaaaaaaaaacaaacaaacaaaaaacctaaaaccataaaaaccctagaagaaaacctaggcaataccactcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacgggcaacctacagaatgggagaaaatttttgcaatctactcatctgacaaagggctaatatccagaatctacaatgaactcaaacaaatttacaagaaaaaaacaaacaaccccatcaaaaagtgggtgaagcatatgaacagacacttctcaaaagaagacatttatgcagtcaaaagatacatgaaaaaatgctcatcatcactggccatcagagaaatgcaaatcaaaaccacaatgagataccatctcacaccagttagaatggcaatcattaaaaagtcaggaaacaacaggtgctgcagaggatgtggagaaataggaacacttacactgttggtgggactgtaaactagttcaaccattgtggaagtcagtgtggcgattcctcagggatctagaactagaaataccatttgagccagccatcccattactgggtatatacccaaaggattataaatcatgctgccataaagacacatgcacacgtgtgtttattgcagcactattcacaatagcaaagacttggaaccaacctaaatgtccaacaatgatagactggattaagaaaatgtggcacatatacaacatggaatactatgcagccataaaaaatgatgaattcatatcctttgtagggacatggatgaagctggaaaccatcattctcagcaaactatcgcaaggacaaaaaaccaaacaccacatgttcttactcataggtgggaattgaacaatgagatcacatggacacaggaaggggaacatcacactctggggactgttgtggggtggggggaggggggagggatagcattaggagatatacctaatgttaaatgacgagttaatgggtacagcacaccaacatggcacatgtacacatatgtaataaacctgcacgttgtgcacgtgtaccctaaaacttaaagtataattaaatatatatatatataatgtaaagggagcaaatgcctgctttaagaattttcacttaaaagttataaaatattataaaattatgtacatggagattcaatttagaacactagataaaaagtataagtttcaataaaaaaaacccttaatgtgtattagaatcacccagaaaggatgtagaaatgccccacaggaggtgaaaattaggtgtctgtattttcttgccaagtgattctattggatgcaaaatgtcaaaagcatctccataggcaagggcaatagagcaggagtgtttaatcatttttatatcccaccacctggagtttaaaagctgctcagttgttctttgttgaatcgatgactagaagggagaatgaatgaatgaacaaatgggtgaatacatgggaagggggttgtcaatggcacccagttcttcctaacttgattagaaagttagtaatttacagactagcccagctcatccccaactgtgatttctgcctttgaagtctcaatttgattaaaacacgtttagcaaggaacaataactttctgaaattctggagattatgcagctccaagaagctctgtggggaacaagcaattccagcaaccaagacaggtctttgtgaacctggagaggctgctttgcaagcctgtatcgaggccaaacatctgacttctcttaattacattctgtccttgtttcattccttctcatctcctgcttctgggtccttagttttccccaaactggcagggttgaatgatctcaaaaattaggctgggcctgctcccacggtgctggggcctgaggcatggacgagtctccttcaccatgaacaatggaaaaaaagtgtaggtcattttctctcccaccctaaacttctgtcgcaaagtgattttgcccagtaccttctgcagggtaatgatgctgtttcattagtaaaagaggaaggagcactgactctggggtgtgacctacctgtgtttaaatcacagccttgcccctttccagatgagaaaaccacctgtcttccaagatgtctatgagggtttatagcagctaaagaagtaacatcatgtaaagattaaagcaaagatcctggcgccctcctgcataggtaccaattgtaccaatctcagatctcccacttagctggataatcctggacaccttacttaactgacctgtgactcagtttcctcatatgtaaataggaatgaataattataactccatgccatttagtcattgtgaggggcaaatgaaattaatataaggaccaaactccgaccattttcttctcttgcccaaagccctatctaagggacctgaagagtcacatcctacagacaataaagtcttgtcagaggggttttattccatgctatataacatggcttagtttccaactttggcagaacatcacatgacagataaaggaggaagtcaaaatattttacctccaaatatgtttctttgccgtatttttaaatggcctgcaaagccattcttgttggggaaaaatgcatcttatatatatattctctattaacataacaagatctttccccattccaggccctcccaatcttgaagagactatctgagaatccagcatcttttagaggtctgaatagaaacactgaggcttcatgcacataagaaccctagtctccacaactccttctcttaacccagaaagtcctttctcttgattccaggcatttctataataatttaactctttcaaccaattgcaaatcagaaaatctttggactttgactctaccttttacttgtgccccaccctctaccccacttcgggttatcccgccctatcagactgcaccaatgcatgcctcacaggtattgattgatgtcttttgtctccctaaaacatgtaaaaccaggctgtagcccaaccaccttgggcacatgttcttgttctcaggacctcctggggggctgtgtcctgggtcatggccctcacatttggctcagaatagatttcttcgaatattttacagagtttggctctcttcatggataaatacatacaaggactgagatgattttgtgacatgtagttatccttctcgtgttacttattatgacaaatatctataacaatcatggtagctgttgaactacttccatgtggagaaatggaaaactgtcccatcctctcaaacgaggttttcagatgctctgcagttcctctcccctctatttttactttgcatttatctctttaattgggctgaggctgctggttgtaatgggtgttgctgagtcatctgaggacacagggacctatgtcaggaagaattgctggcagggaagccatcgaaagacagattagacatctccaaggcaggagtgagtcatctggtggtctgtgccttgtaccaacacaccggagccgaggagaagcacggatggctctgagacatcttcaatttcatctgcagcatggctaattctcagtttaataaaactagcctgctctgtggatgcacaggctaaacattgcctgaactatcacttagcaaacatttcttacctctcccactccttctttctttgcctctctctccctttactcctcccttttttctctctcttcctttctcttctctctccttactttttgactctattttttttctttttttttgggatggagtcttgctctgttgcccaggctggagtgcagtggtgtggatctcagctcactgccacctccacctcctgggttcaagtgattctcctgcctcagcctccagagtagctgggattataggtacctaccaccatgcctggctgatttgtgtatttttagtagaaatggggttttgccatgttggccaggctggtctcaaactcctaacctcgagtgattcacctaccttggcctcctaaagtgccgggattacaggcatgagccatcatgcctggccttcttttctcttctttatcctttattattaccacctccttctccttttttccccctctaatttctccctcatatatctctatccctttttccttccccacactatttgtctttctttcttcttgttctcatcttcatcttctcccttctcttaggagaactggacaaccaactttaagtcttcttttttttttttttttttctgagacagagtctcattttgttgcccaggctagagtgcagtggcgcgaactcgactcactgcaaactccgcctcctgggttcaagtaattctcctgcctcagcctcctgagtagctgggactacaggcacccaccaccacacctggctaatttttgtattttttagtagagaaggggtttcaccatattggccaggctggtctcgaactcctgacctcgtgatccaccctcctcggcctctcaaagtgctgggattacaggtgtgagccactgcacccagccttctctgcccttcttatctgtctccagacagtctagactaggtgccatcaaacttgttctgtaaaaggccagataataaacatactggcctttgcaggccttatggtttctgttgcaatgactaggctttacatgtgattgggtttcaataaaacttcattttcaaaaccaggcagtaaccgggatttgggtcatgggttttgataaatgctaagggaaatactattttttcttggtcgccctcttcatcataaaccagcagactaaagaacagatttcagcctcatggtactaatttctgggcccctgaaggtacagtccctctctcccaggttcttgattaaagagactgaatcccatattccagaaccctccctagatctggtggacatggaagaaccatgagttctgacttatgttgctgactattatgtgggaacgcctgaattcctgtctgagtttagagaatttggaaaacaaaccttggttgataagatatatgaaacatacatacacacacacacacacacacacacacacacacacacaaacacataaataaattaaggaggacgcttttgagtgtttaaattcttaggactgcagcagcaagtttagcaaagaacacagtaggagctcgatccagtttggcaaagggtctggctaagtcaaaactgtgcaattatcattcctggttgttggggttttagaattctctattcatgctaatgacattgcaatgaacaaaaccacatcagtgaagaacagcaaaagtcaagggtggagcaacgcagctttatttcacaagcccctccttggggaaggcattagagctacagtttggaagaggtttgcatggaagaaagggagaaactgtgaacagggctggtttgtcaaagaaagacataaaccagtggtgtgtgcctgggaacactatggatatgaaacttgtctactgttctcccattagcatgcagtcttgcctgaaataaacaaagcacatgttttggagtccacattgtttctcctgtcttgcctctactgtgctgcagggaaggagggtgcctgggagacagcaaggctcattctactggaggcttttatgatttggatggggctgctgaccaatatgcctggagataccccaactgtcctctacgaccattacttctactgcagaggtcaagtctttcccaaagaaacagaacaaaggaccatcactggttttgtgttccctttgttttgtttttaatatataatttgtctaggaggcagagaacctgggtttgagccccaactctgcactccctcgctgtgcatctttaggtgaggtcatatcccctctgtggcttcagtttccatattactggactaagtagcaatttatgatccactacagttgtaaaagccagggaatatataattctgttggttatatgcctcatattgcacatattaaatatgtgcatatatgtgcctcatatgcatattgcatatattgcattaaagagcataatacagggatatttgactattataatatacaaataagacaatggaggaatttgcctctatcttgtggtgaatacagaggtaagatgcctgggaagactgtcaaaagattggcagtgattcagtgattacctccttgcatctctctctctagaggtatctagtgtcctttctaaagaaaataaggtccctttcattaaagaaggtattaaatcgatgacataagacttgcaaaagtgtatctgcagtattttctaattcattcatttgttcattcattaaacaaattttgtttatgccaagctccactgagtcctgcagtaagggaacagcaacaggggtggacatggatagcgtatgccctcgaggaatctataatgcagtgcactcaagtggcccagggcacatggagaggccaacaatggcatctaatgtgtgccaggcatggactagcttctttatgtttattttcatatttaatccttaaagaattctgattttaaaatgagaaaaatgagactctaagaaattaatttgccccaggtcacaccactaggaaactgcagaaccttcatcttacttatttcacttctcttgctttgctaaatgccacaagtgtagagataagggagttcacaggcagggtatctagcttagaggtctttatgggagtattcacagaggagcgcagaggctgaaggatggatgagatgtcatatcaggaaatggggttaggaaaagagggaaggaggaattccatttttatagggtgttgcatgcagcaatccacacttatctaaaaaaaaaatttcaaatggtgaaattctggatgctgtagaaagttgaaagggaaaaatattcaggggtaaggggcattcaaggatttccccagtccacactgtcataccattcctaagccagccctaagaagactggctgtgaaggcctctcagggatacgccgtcctcagaatggacacatgtgtggtcatcactgcctgagctgtgggactgtccagctctaccccagactcggatgtcagcccaaagatattaagctgggaagttgatcaagggcagtgttgaggatattagcaacccatccagcggcccagagcaatttatgagaattctaattagatacaaggacttctgtgaccacacaaacactttctattctgcctgccagcacggggtcccctgccgtcaaaagctatcttgtatgcttcagtggaagatacaaggccaacaaaaaaaggactcaggatgccaacactgacccactcagagggagaaagtgagttctccattgacttccaaggctcccccactccaagatctgtgagcatcattatgctgaatggtgctattaaaactctagagtccattgcaggaagtttccttattaacatgagagcagggtttgtggtcctctccaatctgttaacaatctagatgagtctttaaaattattgctggcaaaagttgcagtacaaaaggaacagagggaacctgatgaagtaaaattgtgtgtgtgtgtgtgtgtgtgtgtgtgtatctttcaaatatttaacatatgattatatgtacaaatatgatataactggggtcactcactagttttaaaacttggacagtccaggcaacattggttgagttggtcactctattaatgtaattattttttggagacaaggtctcactctgccacccaggctgcagtgcagtgacatgatcatggctcactgcagcctcaaactcctgagctcaagcaatcctcctgcctcagcctcctgagtaggtgggcctacaagcatgtaccaccatgcccagtaatttaaaaaatttttttgtagagatgggtttttgctatgttgcctgggctgatcttgacctcctggattcaagcaaacctcccacctcaggctcctgagtagttaagattacaggcatgagccactgcacctagcctaatataatatcaatgcgagagatatgtgtaccatatctttcaaatacttcacatatctattatatatacctaaatatgatataggtgcaattgaatatgccatatacataatttttaacatacatgataaatatatacatttaattttatgtgttaaatgacctcagactagatgtcagggatgagtaatgtctattggagtttaaaaataaatccacaaccattaaaactgagcaaaatacaaagaagaagattaaacgcttctcaatactaaaaagtattacttatagctaagctgacctggccgcctgcaaaccaggtttctccttgcagcttggtttagtaggaaatgatcagaattggactcagatgaactagagccaattgttacctctataaaagtctgaacagggtgttgtccattggctggtagcctcagcatcacctggcagcttgttagaaatgctgggtctcaggctccaccctagacccactgaaacagtctttgttttaggaagatcctcacgtgattcttgctcatggtaaagctgaatgagctctgctgcagttcactttactcattggagcctcattttcctgctttgtgcaagggagataataagatttactccagaatattatataaaggcttactaggatattatatgtgatgtgcttggcatagtgctgaaccatagatgagaggacctaaaacaattttttccttcccttttctcagcatcacttgtgactgaataataaaattaggcattcttgttcttctcagtatcttttgttctggcccccagatatgagaagggtttgacctttatggtctttcttctgcttcttcaaaccccacaatcatttttttgaaaatcacaaaatgcatgagatagatgggacttatgggatcccctgttcacctttacttcaaagccagaaatgccattctttaagtccaaggcttacccagtcttcaggttctcactcaagtgttaccttttagggaccaagcagaatcgaggtactcaataaagagttgctggttgctggatgaataaatggctgagtcttctgtgaaccctggcccattctattctttgtctaaatcttgccacacgtgttttctttatgaatcattctgtcctttattcttaaagatactagttatgtctcgtatttctccttgaccattctcttatctacccaacacacctaagaatatatatgtatgtatatatatacacatacataagaatatataccacatacataacacatgtgtatatgtatgtctacatatgtgtatatatacacgtgtgatataaatttatatatgtgaattactagaaacgtttcgattttaggattagatattttgcatttatacatttgtcagcctactggactgtaagttcattgagggtaagaagaaaaagaccatgataaccccttctgggaatatcagtgcctacgaaaacatctgtttctcagtaaatgttgggtatcgatgctgagcaatgctgaaacatatgcatgagcattgttactccagtactgagagccaaagatgccatggtgcactctatcattttagaaagaccacagacaattagatggaaaaggaaggcaacatcttgctaggatcttgtgtatgcttccaggcagatgaacagcctttttcctagggaaatgcatggcaggcttcatgtaagaggttccctcaataaccaaacactccattcaaaggttatatttacacagctcattaggaaaattttttatacttttgacactcattagactcataatcgtccactgaagctactgtgtaacaagagataaacactccattctagaggatgaataattaggtactgctcagcactgtgctctttacacgtctaattttagagcataattaatcctgctgaagctgcatacgataagtgaaatatttatgcagctgtgttaattcatgtatttactcctagagagacattcagaattggtcatggctttccgggaagatcatctggagacaccccctggaccaatggcattttctctcccaagtcttatgcctcccgatggcctcaagagatgaagctgaatagagacatttcccaaacccaagtctgaccaggaaggcaatgagccagaacagaaaatatcgatgagaacctagatgttctgtaagtacatgaacaaacccctggcccatctggatgcttttactgtttattttttatttggtgcaaagaagaccttttctgtttagcaccacaaaagttgtttctgtgttactaacttgactacattattgccagtgcaacactaaagaagttgtgtttgatactagagttgtgcacgggcaactatggtgatgatgagaaggagaaggatgaagaggaggaggagggtggtggtgatggccatgatgatggtggtgatgatcgtggtaatgaggatgatggcaatggtcatgatgatgatgatgatgacggtgatggtggtggtgatgataatgataataatgatatcagaggcgtgtgaaccagaacactccatcttaaatagtagctgggtaaaatgaggctgagacctactgggctgcattcgtaaatggcttaaggcattctaagtcacaagatgagataggaggtgggcaaaagatatagatcataaagaccatgctgagagacaaaacaggttgcagtaaagaagctggccaaaacccaacaaaaccaagatggccatgagagggatctctggtcgtccccactgctacactcccaccagcgccatgacagtttacaaatgccatggcaacatcaggaagttaccctatatggtctaaaaaagggaggcatgaataatccaccccgtgtttagcatatcatcaagaaataacccagccttgggtctgctctgtctatggagtagccattcttttattccttaactttcttaataaacttgctttgactttactccatggacttgccctgaattctttcttgcatgagatccaagaaccctctcttgaggtctgcattgggaccccttttctgtaactacaatggtgatggctaacatttattgaaccacttgtatgttacagggtctatgctaagctaagctatgcactttacatgtattctcccatttcatcttcacaccagccttattaggtaattatttctgtaccctttcacagatgaataaaccgaggctaaaaaagatcacttctttcatagaagtatttgtaaatgggacagtagatttagttcagatgtgcactaaattactccttcctaaaggatttatacatctcaagagtttagtcatctttgatagataacttagagaattaaatataacaacagtcttccctaattggcccccttccagagtaaggtccctgaagtagaagctttgccacttactagctaggggatttgccctctgagattcaatttcctcctctgtaaagtgggaataagcaacatttaacctcataaggttacgaagattacattgaggaacgtatgtaatgcatccagtatgatgattgacatacccaagtccctaaatatgttagctgttttataatagatgcttcgagagtgacaccaatggtgggtggggctagagttagaactcacttatttgacagatacctatcacatttaaaagtttccagccaaatgaaatacatcttaacatcaatcaatcattcatccatacatgtatttattcattcaaacctttattgaccaatttacctgtgatgttcagtgttttgttgtaatgctggaaataagactcctgtttgctgaatagttcatcccctgtaagggtgattatccacccctgtgataggcaaaacatttggccccaattcttcagcatactctcagtgtccacactattgccataaaacttcaagacctatctcatgaaaggcagagtatacctgcaatcccttgaccctgaacttggccacctgacctgctttggacagaaggatgttagcagacgtgaacgtgaccaagcagtggcttgaaatgtgcatgtgcagctaggcgttcctttctgtgcttctgccatggccaggaaaagagcttccccaggtagctgctaccttttcagcccgagacacagcagaaacacgtgtggagcagagaccacaccactgattcgtacgcttgtggcaggaagcagaggcactatccccaccccaggcagagcttctccactcaacctgcactaccatgaggaaaataaatgcttactgttgtacgcctctaagatctcacagcaaaaagctgaccaacacagccacaaatcattattacacagcagagaacatggccagtgatctgaggaaggtacaaatgccctatggagaattcaaagactcacatgttctcatttgggagttaaatataaaacacatttagaatgcctgatggcactgtgagaatctaggatttaactctgtgaatagaaagaagataagaagccacaagtaattgtgcacttcattcgaattcacactaaccctatgcactagctaacctctgcctattttgatattgcatttcactgtagtggtaactagatttttctctcccacctgtagcctggcataacacgttctgtaatcatctctgaatatagcctccactatttgaacggggcttctgccctctggcttgagcctttctatcctcctcataccgagctcatttttggtgttaacctgctatctgagctgactttgcttttcctatttcctccgtgttggcaattgaaaggaaaccaacctgccattccaagccacggccagcctctagaggccatgccaggaaaccccgggctatagtgagatcaccagctatgaagtagaaagggcagacaggaggaaatgcttctggtgacacagctggcccaagcggctttacagttctataaatgccacagtctcattagactgcaatagagattgcctttccttcattcctccacgggataagaacatgagttgccatgttggtacaacatgactccaccgtgagtcatgcctgataagtctaggaaagagtctttgacctcaaaatgcatcagaaatcctttctctggagtgaaattgggactgattacagcctagttatgtaattttgtacagcagcgtttctcaaccacagcctaccaacatgtgaggttggataattttgtgttttgtgatgtagggggctgtcctggaccctgtaaggtgttttcctgcatcttctggccctggcctctacccattagatcagcaagcagattcccagccgtgatcactgaatgtgtctccaggcattgccaaatgtcacctgagggacaaaattgcccttcaccctttgagaaccactgccctagacagaagacctataaattcccacttaaggcaccaggactgtcctggctcttgtctttttctaaacctatttaactctttcctaaatcccctgagagagactgtatccttagaatacttttgtttgttaaatttagttatctagaattgctttccattataagcaacctaaagaaccatggtttcatgtgacaggaactcagtaaatatttttagggagcaaactcatcatgcaaagatccactgggaagcccaggagcaaacaaagcgagtgtgagggtctcaagtccccctaaagaaaggggtcacccggggtcttaccatcacccacaaactgaagcaaggccaggtcgatctgcctcttccaaggagagcctttctgaagggcaattccataaccggtggtggcaaagatgtacccactcccgatggtcaccagcttgcagccttcatccctcccagccttgtaattcaagactgcggcatcgtagatgaaagcgtccagcttcctgaaatgacaagaaaccagggggtcataggggtggccaggtaccacctcggggtccagctcctgaggcctgatcctgaaagcatcccacactttctttcatgctggtgatgatgactcatggcctctccatcccctcatcataaaaggatctatttttaatgaggagataaaagccagaaccttttctctccaacttacaagaggcagctaaataaagacatgaaggatccatatacccaagtgagtaaacagttgagtttgctggtttgctaagtgtttgtccttaacactcccagtggtggaggacagtgccctatttagaaaggtttgcatcagaacaaaataaaccactaaggggcagaagaatttggtggtagtgtgtatgaaggggaaaggaactaaataggaatattttttcctcccaaaagaaatacatgtgctgcttatttatcatacagaaattattgcagaatttttaaaaatccaaataatatagaaaagtattaaaaatacaattaaaattaaagctacctataattctataactcagattcaacctttgttaacatgttagtgaacagccttccaaatgttttagtgagtatgcacaaacacgcatacacagagattggcaaactttcttctataaagacaagataataaatagttgaggctttgtaggacataccgtctctgttgcagctattaaactctgctgttgtagggtgttatggggctgcactgtgtccacccctaacattcatacagaagtagggtgaacccctaatccactgtggctgccgtccttattaaaaggagaaatctgaacacagacatgcacacagggagaacgccatatgaagactggagttatgctgctgcaagccaaggaactaccagaagtcaggagagaggcctggaacagatccctccctggagccttcggtggaagcgtggtcctgcagatgccctgatcttggacatctagcctccagagctgcgagacagtcatttctgttctttaagctgctcaggttgcattcctttgttatggctgccctaggaaaccaagacatagtgccaaagcagccatagagaatgtgtaaacaaacgaactttgctgtgttccgataaaatgttatttaggaaaacagatgggtccacgggctgtagtttgccaacccttgttttaatcccgaaaatgttattatgccacacaaactatttcacatattgctttcttctctcattccatacctagtgaatatatttccatgtgaatacacatagcacttttaaattcttttttgatacacttatttttattgaggtataacgtatgtgtaataaaatgcttgatgaatttttacatatgtatatatccttgaaatcaccatgcagttcaaaatgtggaatgttatcatttccttagaaatcctatgcataccccagaaaataagcatcaggtaatctctccaagggcacaactgtgcctaaatattattattattattattattattattcagatggagtctcactccattgcccaggctggagtgcaatggtgcgatctcagctcactgcaacctccacctcctgggttcaagtgattcttgtgcctcagcctcccaaatagctgggattacaggtgcctgccaccactcccggctaatttttatatttttagtagagacagggtttcaccaggttggtcaggctggtcttgaactcctggcctcaagtgatccacccacctcggcttcccaaagtgctgggattacaggtgctaattatgattagatccctgtcagtagtcctggatattgtttccaaatgttaaagttatttaacgaggctgaaatgatcactgtggaatgcagggatgaatgtctcaactctaaaatgggtaagaaaactaaatcggagatgactcaacttcatgacactttctcaactttattgcctttctttaacaagaaaacataaaacagtgaagcaaaaaaataaaaataaaaatggcaaagagaggatgtgaaacactgcatcttttcagagacagctgccgaaggactccctatgggaacaaaactatttggcaggtttacagccgtgttcttcattttaatttttttttgtttctataatggtttgaggtggcgcaaaactgtaggacttgtctcatccacagaaacactctgaagctttgatctcaaggtaggggtatcagagacttggttttaggctctgagagtattaaagggaatcagatcaagcagcagcagaagagaactgggcactgattggcaacagcgatggtaacctagagctgtcatacgtaacctggagcaacctagagcttggcttgatgacagcaagtcaagaggaacagccagcaatagtgagacctgcagaaatatgggatggagagttatacaaggtcaaaagtaacttgtgtataatgggagtagggtgtgtaacaggaacactggagtagtaggtgaaaggaacctgagttctagtctaggctaggatgatggtgcaacctcaggaaagtcactttctccttttggatttctggtttctcctctgtgagaggtggcgttcattgtggtcttgctgagacacttgttcagctgtggtattctaagattgtgtgagccaacagtcacattctgtggctatccatagggaaattgaaactctggataacacatgtatcctaaggacttagggccgtggaaggtgttggtctcttgataaagctgagatacttgcaacgtcaatacttcccgtatccatgttgccatggagatatagaaacttggttttatttagactttctaagtaccacccaactctcgtctctccattcctcaaaaaataaacatatacacacacacatgtacacatgggcacattcaaacattagggccctctgttggaattcatggggtgaaaccttctcctatcctgctaagccactgtgcactgaggtgctgctaggctggaaatctacacacgtacctagcaaccacataagagttgtccagaagcagtttaagttggtattttatggacaggcatagacatcttcaaatcagtaccatatttcatgacaggtctttttgagctgagcaacagacagacatatgagtacaaggaataaaggaagttttctttgggaacaaagtttataaaagcacaatgctgaaaagtcagaggcaggacagctgcaaaagatgtggttgactctgaccaaagcagttacacattggcatgactggggtgggctggtggtcatgctgtcagaggggtctggccatggaggcacacaattgggccagccctccatggcctgactgtcatcttagggccatgtcagaactgaagtgattacaacacagaaaggaaactgtagggccacatgaactggtttctagattctagagagctggggcctacacacaatgggctacagacaactgcgtgtttaaaaatatcctggggcatacacagtcccctcccagagagatggtcattgtctgagataccatctcacaccagtcagaaagggctattattaaaaagtcaaaaaataacagatgctggcaaggttgtgaagaaaaagaaaagattatacactgatggtgggagtgtagattagtgcaaccattgtggaaagcagtgtggcgattcctcaaagacctatactgggtatacacccaaaggaatgtaaatcattctattataaacacacaggcacacatatgttcactgcagcactattcacaatagcaaagacatggcatcaacctcaatcaaacccaccagtgacagactagataaagaaaatatggtacatatacaccatggaatactatgcagccatgacaaagaacaacatcatgtcctttgcagagacatgaatggaggtgcacaccattatcctgagcaaactgatgcaggaacaaactatgaattaaaataaataataacaaatggaatcactaataatcactttaaaaaaagagatggccattgtctgcaagatgttttataaaataatacttagcatttcacagacatcatcccactgaggcctcacaactgtccagtagcaagatattattattgttattatttttctattctgtctataagcagacaaggttcagaaagcctaaggcagcctggggcttgttggtgatatttccagactttatattataaaaccctctaggacaacactgtccaatagaactttctgcaatgctggaaatgctctgacaccatctactatggatatcgagcacttgaaatatgtttagtgcaaatgagttgtaaatttcatttaatttcattaatttagattgtaatgtagggggtcccacgtgcctatgggctattgcggcacagccctagctgttctgtggcaagcaaggggaaggcttagggagcaggactctgggtctccctttttgctctgacccaaaaagtctacttttgatccgttttctattggaaaaaataattgttcctgttgttaaaaagaaaaaaaaatcccctaaatctctgagatttgtcaacagggactttgggcaaagcaactgcatttctcaggctcagttttccctatgaaaaatggagccaacttgccgggcacagtggctagcgcctaaagtcccagcactttgggaggccgaggtgggcggatcacctgaggtcgggagtttgagaccagcttgaccaacatggagaaaccccgtctctactaaaattacaaaaaaaatagctgggcatggtggcacatgcctataattccagctactcgggaggctgaggcaggcgaatctattgaacccgggaggcagaagttgcagtgagccgagattgcaccactgcactgctgcactccagcctgggcaacaagagcaaaactccatctcaaaaaaaaaaacaagaaagaaaaatggagccaacaatatttgcccttagagggctgctgggaataaagtgttattatataagtaaagtatgtgtgcaatgctcagaacataacaaatgctcgaaacacataaatgcattcaatcaaattcagattttatgccaaaggggctcaccaattttatggatcctataggagaaatccagttctgcatactttatatgcattattatattttttggtccttctccttgtgcagggatgggcatactactgccatccccattgtcagatggagaaactgaggcattgagcagtaaagtgactcagcactaccacccagcccatacgtgtcaaaagtggcattggaacctatgcagtctgacaccaaagaccactgacataaccactgtgaccaagccatgctatccataagacttgtagagtaaatggaggcagctctattacttagaaaattcagatggggggttttagctataaataagccaaatgttttgacagaagaggcaaggatggggccagagcggccggagtttcaatagtcgtggtgggttgttccacttcatctgtctcgttcccaacagccacagagtcatctaaggggctgcagttacctccatagaaaactcttgcccctaacatagtctactccagtccatcggaagacatgtaggtataggtggccatagcttcttgttgaagatggagggtaagaaagagaaaaaaggccacctgaaacggaagcccgccatatttcaagtgcttaatttccatagtagacagtgtcagagtattggtctgatgtggaccaatggcatttggaggggttgagctgcgactgctggactcagagtgacgtgttaggctgcagcctggtatgggcagcactggcttggaacaccactgaggggctggttccttagaaccaagagcatccaactgaaagcccagttaagaacacacagctaagggaacccatttactcttctctgcttggtgcatgttctcttccttttttgaagaggaatttgtctttgtgccacattctcagttcctacccaggtaccagggttgtgtttctcccactgggcaggaggacgttcagaggtcaggtctgagaactgtgggatgttgcctgtgatgaggacagagacaccatctgacacactggggtccatgccacctttctgcctccactccctatagaagatgttggagaggagcgatccctcttctccaatgtctgcgacagaccaaagacaccttggcttcacaccatgagggctggagcagtgctggagctcaaaagaatgccatgctatgctggctacatgacaggctcaccccctgccaggcatcttagtggctgtgcgggtgccattaccttctccatcaccggcagtcctcaaggagcacaaatgattagaaatgacagtaattcagaacaagagggggaaataagacctcctctctgtaaattagcaaagaagcaaggtaaggacggatgtcacatgtgccccatgctactttaacctagtggtttcctgccatccttattgacagctctcaagagctgctacagctttcacaagtgtgtagatctgaccccattcctttagtcagtgggtctctcttatacctgcacaatggccttgaaagtccaatcctagccccaagactgtttactggcaaatctaattgtccctaccctggggaggactataccccacagtagaggcatggacacattagggatgggaacttgtattatcaagcggcttgacatttcctaatcaaaagtttccggttttagctcatcatcttcttatgcatgtttgcagatgctctctgggggtctcagcacatttaaaggctaattatatagttaaagttaattattcattcattaacattcaagaagcctttaacaagacactgcttgtcttgatgaattaatgaaaccagcatgtgcacatgagtgtgtgtgtgtgttactgaaaattaaaacatctctttgatgataactgaatatatttttttcagatcaaaccaaacccttgccaggaagaggaacacattagcacttgaggtcagttggcatgtttgggcaactgtggaacagggaacacaattcagatttatcttcaccagctccatgagtgaagcccggtcatgggacctctctgagcttcagtattctcatctgtaagatgggaaataaataataacttattacagggctggctgttggatggattaaaatggaagtgaaggtgttttgcttgtaattgcagatgctggtgggatttaggagattatctggcagtggtggtatcattatgcagagaagcagtggaggtgtggatcaccaccgggtacccatcggggaagggcattcatgatccccagaaatggcaccactgaggcatgacaagctttgaaattgtttacttgggcaagagacactcaacctatacagggactacctgccatcagcacagaatggtctaaaactggctttgggaaaatggcctagaatcacattttgattctgggtttgtgaatacaaactctaaagtcagagttataccaacattgatgaattttcacaaaggaagcatttttcaaagcaaactcccttaagctaatttaattcctcgatcgatgtcttgcatagcgtagttaaattgtttccaacttttttggaaacatttttactggggtcaattcttttgtgtttaaattttataaatatttgcttcattgatcaggatttggaccacaacaaattttactaatttataacttctgccattttgagttttcttttgtggttattatttccaccaagtcaagtccatttctcctgggtcaaaattgtacagagatccaaaattagctaagaagatttgagtcatctatggatttttagtcaataccaaatttcaccctgtgtgctttcagctcttgtcagtttattttgtgtggcttattttttttaccaataatattcactgtgaattgggcaaaaaagatggatggttaatatttatttttttagctgataataaatcctgagtgattttgtaagacagaggcagagagaagcagagaaggggagaggatagaagagaggaagagaactagggaggaggaagagatccagatggaaggaggtaccaagcaaaacatgaagacggagacagaaagagagaaaaacgatgagaaagagaaagtgaggaagagaaacagagaaggagaaagagatgttagtaaggtacagagagggagagaataaaaagtgagatatattgcaagaaactaagagaaaaaaggggggaaagaaagagagaaaaagaggatagaagaaggtaacggggaaggagtgaggacagtgatatggtttgtctgtgtgcccacccaaatctcatcttgaattgtagctctcataattcccacctgttgtgggagggacccagtgggggataaatgaatcatggggccagtttcccccataaggttcttgtggtagtgaataagtctcatgagatatgattgttttagaagagttttcctcttttacttggttctcattctctcttgcctgccaccatgtaagacatgcctttcaccttccaccatgattgtgaggcctccccagccacatggaactttgagtccattaaacatctttttccttataaattatccagtatcgggtatgtctttatcagcagtgtgaaaatgaactaacagagagagagagggagatggagagggagagggggaaaaagtggggggagagagggagggaggggagagagggagggaggggggagggggagggggagagggagggagagggggagggagagggggaaaaagtggggggagagagggaggaagggtggagggggagagggagggagagggggagggagagggggagggagagagggagggagggagggagagaaaggagagacagagagaaagagagacagagacagagagagagagaaagagaaagaatacccaagagatgaatgtacccactttgtctattgactgctaatttcaaagatagggaaggattgaaatgattgtccaagtccatctagctgtaagtactttgtttctgttaaatgtaacgttggacccaaactgactatacccaaggagttgagacagtatgtaatccagtctcttcatttttcagatgaggacactgaggcccagagatctccgcccaatttttccagaccggtctgtcactcaccaaagcagtgtgccttcaggacaccattgccgggctcccccagtgcaaggcctcagctgggatgcagggtcagagaactggctctgcatactttgtggaaagttgggaaagtctaaatatttctctaagccttgatttccccatctgacaggaaggaaaacataatctgtctcctatgtttatgcactggttgaatgaagtcccagccatgaatttgtttggtgaattgcaaagcactatgcgatgctgtattttcttcaccacaactcatgctctgacataggaacagtattggttctttctggaatgctactctttatagagcttcttagattgtacttttcaagggttgaggtcagacctaaccattctgctgcagatttcacgaagcatagcgtttttataatattagaaagatggctcaaaaaggttttctttgttcagacttttcttgaacatttactatgtgctggacactgcactctttgccggaatatctcatttaatctttacagtgcatttccaagtgaaggcagcacaattagtataattttataaaagtggaatactggagtctaagatgttaataacttgtccaaggtcccaacactggatgtcactggagtgggaattcgaatccaggatgcttatcctttaagcaccccatcatactgttagtagtgacgacatcacggaacttgtcacacaggaggactgaaagacagggactctcaggggccagaaaacatgagagtgaaagagagattccgaaaaacatcgagatttgtgaaaatgctattatgtgttagatagaatgcagggtactttccataagtcaacttggttatttctcagaggaattccaggaaataggattttacacatgtgggaaacaggctgagagaggttatttaatttgccaaaggtcacacagctggtattagagacagaatattaaagtaggcgtttcttaccccaaaatccactctctgcaccaagaggccactcagaaaatataaaaataagcaaatcaaataaattgactacgtaagtttgaaggcttcaagaaaatataaatacttccacccagaaattctatgtcctggtttcattcctagaaaaccacttgtagaggtacacagaggactccccaacgatccttaacacagccatatgactgatagccctcatcccacccccccaaaaaaagtctagtgagaagaaaatgcttaaaaatattctgatgcatgcatatcatggagttctttccagcagtcaaagagaatgaaggcaaaaaatggaaagctctccaaaacatatcgttcactgaaaaccaaactgtgacatactgcatagagtttgatagcattccacagaataaaattttattctgtgtggacatatattaatatatacaaatgcagaccgggcacggtggctcactcctgtaatcccagcactttgggaggccgaagtgggtggattactgaaggttaggagtttgagatcagcctgggcaacatggtgaaaccccatctctattaaaaatacaaaaatcagctgggcgtcatggcgcacccctgtagtagcctgtaaacccagctactctggtggctgaggcaggagaatcacttgaacctgggaggcagaggttgcagtgagccaagatcgtaccactgcactccagcctgggcaacagagcaagactctgtctcagaaaaacaaaaacatatgcaaatgcatataataaaagtcttggagaaatggaacgtacatcaaacagacaacagattggcattgagatgccaagccaaaggaatgcttatctgtattttcatttttttttttttacaatgaggatacattttttaatgagaagcaatatagcataatggttaagggcatagctcctagagccagttcaaatcccagctctgaagcttaccagcactgtgcctgcgtcatgacttaagctgtctgtatagtggagatgctgggcatgccaacctcccagagaagctgtgaagattaaactaagagttacaggtaatacactcataaaagctgctggggccgggtgtggtggctcatgccagtaatcccaacactttgggaggctgaggagggtggatcccctgaggtcgggagttcgagaccagtctggccaagatggtgaagccccatctctactaaaagtacaaaaattagctgggcatggtggcacacacctgtaatcccagctactctggaggctgaggcaggagaatcacttgatcctaggaggtagaggttgcagtgggccgagatcgcgccgttgcactccagcctgggtgaatgagccagactctgtctcaaaaagaaaaacttcctggcatggagtgagggctacctaaacaactgagaccaggaggcaggggatagggaaggtatgggaaattggccagcacaattaccacctgatggtgggagttcacacgcaagaatccactttgcatacctgtgtgctgtgcattcctgtggaatacaccaccactccccacagcacacccagataaagtactgggcagcatggcctcttcccctggtccccaagacacctgaggacagcctccactggcagcactgatgtcggatacctatcaggaggtgatgttgggaaaaccacactacagcctaggtgagtatacctccaaattcatgtacacctgggacatcagagtatgcccttatttgaaaatcatgtctttgcagatataattgtttaaggatcttgagataaagtcatcctggatttagggtgggtcctaactccaacggctggagtccttagaagaagaggagacataccaagggaagaaggtcacctggagatggaggcagagattggagagatgcagccacaagccaagaaacacctggaggcaccagaaactggaggacgcaaagaatggccctcgcttagagccttcagagggagcaaggccctgctaacaccttgattttggactctggcccccagaactgagaataaaattctgttgttgcaacccaccatgcttgttattggttatggccactctaggaaactacttcactggggacacctgaaggtgcagtacctgagttcctatcactcctccacctgcatttctctatgggaggaaggaggtggggcttgctttgggagaggcagctgtctggggttggccccgggcactttccatggggtgtaaacagtgtctcctaacctgtgttagaggctttccatggtctgagtgagcccagtgccaggaaaactcacttctccctgcagcaagagaacacacagggctgatacattaacaccatgacctttttagcacctgggtcagtggagatgtgtttataattttactgtggggagaaaggaagctgagctattccaaacctgtgatgcttcatgggtgagagcaacttcgcatctcctaaccccacgaccttgtaacagataggtacaacccttgccagagctgttcccttctcaggacaagcagagggttagcacaacatcatgggtcagaaaagatgttgggtcttcaactgaatgctggcactgctactcattagatgttaaccttcagacgaactgtggcttctgcctgaacttcagtgtcctcctctataaaatggagaaaatgattatctggcagagttgaatcaggaggaaatgaggtcacatgtttgaagttcccatgtgagttcagcaagcaataacaagaggtgggccaggtgtggtggctcatgcctgtaattccaacactttgggaggccgagacaggcggatcacttgaggtcaggagtttgagaccagcctggtacaacgtggcaaaaccctgtctctactaaaagtgcaaaaattagccagacatggtggtgcacatttgtggtcccagtactcgggatgctgaggcacgagaatcacttgaaccctgcagatggaggttgcagttagccaagatctcgtgactgcactctagccctggtgacagagtgaggctctgtctcaaaaaacaaacaaacaaaaacaaacaagaggtgatccctaaggatatagaacctgccagggagttcctgcttcttcacagttcttccccaggaggaattttctgaccatgtgcttcctgtggcttggctcgaatagaagaaattcatttcctccacgctcttgctccacacattcatttattttccttatctcaatggaagaagaaacattgccccttttgaaacagtagtaaagattttaaagaaaaaaggagaacttttgaagtaaaaatatgacgaaattggtactaggttttgcataatggtgggccattagaaacggccttaattgtggaatattatgagaacagtcatattttttattttttttacattgtgactcaaagcaggggctctggcgtaagattgatcccagacacgctgcttaatctctcaatgcctgtttcctcaaaggtggatgaaaatcttgatggtcaccgtcatataggtttgtcatgatgtttaaattagataatggaggcaaagcatttaacacagtacctggcactcaggtaagctcccaataaatggaatctgttagttagaaatgcctcacttaagccggtcacggtaactcacgcctgtaatcccagcactttgggaggccgaggtgggaggatcacctgaggccaggagttcaagaccagcctggccaacatggcgaaaccccgtctctgctaaaaatacaaaaattaaccgggtgtggtggtgcacccctgtaatcccactacttgggaggctgcagcatgagaatcactcaaacctcggagatggaggttgcactgagctgagatagtaccgctgcactccagtctgggtgacagagcgagactctgtctcaaaacaaaaacaaaaaagaaagaaaaaagaaataaacaataaaataaataaaaacacacaataaaaaaatttaaaaaacaaagaattgctttgtgtccaaagcaattcaggtagctcacactcactgtaatagaatagaataaggtttacacatacggataaagcaattggagttaagtgaattcagaagtggaatagtagctcagtcttagggaaagtcagtaaacagattttcaggccaaaggctccacaattgtgaaagaagaatcatgcattaagctctgaattgtgcggtaatccaagcaaaaagaaaaccataagttgttataagaattgtgttgtcaacaagatcaaagcgtgcctcaaacagaacaaagcaatgctcttcatcgtacagaagtgtgagggatgctacaggacgacattctccacaagctgtcctgtaataaccgtatcagcaaccttttcaaaaataactatttcttgtagtacccttcagtgctagttaaggcatgatgaaaacacaaagcagtaaaagctaaattaattaatattcctctagctcaatgaaattatcacctggtccttaaatgtggaaactaaacaacagaactgtctactttaattgagaaaagcaaaacaaatttgcatatgcaccgactcaacttgtatgaattgtatatatgcgttgacaatacaagaatgaaatgcaggaaaaaatagagaattatagtcagaagaaacttttttctagctattgcaagtaatactgtgttgctgaaaatttgttaaatgtaaaaagatgtaaagtccatcatcccaatcacctagcagcatctccgataacattttgatatatttctttttagtctgttttttttgccttttttttttttccgtctctgagtttaaagaattatgatctcactttatttaactcctgccccccacagacatttttttctactttaaaaaaagtttttataggtggccttgaaaatcctttaacgttgttttaatagagcttaccaggaaataattccaagaaccccacccccccgcaaaaaaaaaaaagatgtctgtgtttacttgagtttttattaaggaaaaaactttctaactctatgatgtggaagcaattatttttgagctttgtttgcagtgtgggggtggatctcagaaaccaggtcattgttgatctgattttctctggagatgacgctaccccatttagaacagctcactgaaccctgatgtctatgcccgctttcgaattcagcagctggaaatgaaccatttgtgtctgattctgtttgactgataaaatacagcaaataaaacctgctcaaatggcatctttgaaaaaatttgctctgcagagcaactgaacctcagtgacaacccttatactctcctggtttacctttgccttgggaatgccaatatccctgaaccagtttcttttgagcatagaaatgataatgctgtgattttatcagttctcagatcatcaattaatatgatatgtactctataatatatgcacatatgtaatatctaactttagttttaaattctcccctgaaccataaccccgtatttccaactgcctaggtggcatttccaagtggggaagtaagcctaacttctatacttactaattctgcaatgtagttacttagctgaatagcctattgggtaattaggttaacattgttgagcttcacattcttcatctcttaaaagggatattaatggtacccagatcgtaggggtgttgtgaggattaattgagattaggcatatgaagtgctcaggtctgtagctcactaattgtcaggtcacattaagtgcaaagatgcctggacatatgatgatggtgttccaaaggcacttccaacttaatatgcctaaacctaaactcacattttgccacatctccacccatcctgcaccctccttctgaaatatcctccctcttccttgtcctgtttagtcactacagaactccatttctcaatagtcaactaactaacctctcaaagacatggactacctacatctgaatcactagaagcactaataaaaatgtaccttcttggccgggtgcggtggctcaggcctgtagtcccagcaatttgggaggccaaggcaggtggatcacctgatgtcgggaatttgagtccagcctgaccaacatggagaaaccccatctctactaaaaaatacaaaattgacagggcatggtgttgcatacctgtaatcccagctactcgggaaggctgaggcaggagaatcgcttgaacccggaaggcagaggttgtggtgagccgagattgtgccattgcactccagcccgggcaacaagagcgaaactccgtttcaaaaaaaaaaaaaaaaaaaggtacattcctaaatcccacaggctttgcaaacctgtgctctaggataggaattcagtgctcatttgtttttcaatgcaaaactttctatgaagacatttcaaacacatacacggagatgggactacactgttcttttgtttttacagacatgtcactgaggacaactcaagccttttagaaaaatatttattggtaaaaagacaatactccctaaatttttttttaaatgtgcatcaaaagacactatcaatgtaatagctagaatataaaaaggtaacccatggaataggaaaaaatatttgcaaattgtatatctgataagggattgatatccagaatatacagagaactcttaaaacctaacaacaaccaaaaaaaaaaaaaaaaagaaaacccaaacaacccaaatgtaaaatggccaaaagacttgcatatccacctctcaaaagaataaatacaattgcccaataagcaggtaaaaagcgctcgataccactaatcattagggaaatgcaaatcaaaactgcaatgagataccacctcatacccagtgggatggctactattagaaaaacagaaaacaacaagtattggcaaggatgtggagaaattggaacccttgtgcactgttggtgggaatgcaaatgggactgtggaaaacagtatggttgtttctcaataactaaaaatagaattgacatatgatccaattatttcacttctgcatatataccaacaaaaaaaaccaaagtctcaaaaatatattcacacatctacgttcacagaagcatgattcaaaatagttaaaatgctgagacaactcaagtgtccattgaaagatgaatggatgagcaaaatgtggtacctgaatacgatgaaatactgtttagccttaaaaaggaataaaattttggcacatgccaaaacatggatgaacattatggtaagtgaaataagctagtcacaaaaagacaaataccgtatgattccacttagatgaggtacttagagcagtcaaaatcataaagacaaaaagtagaatggtggttgccaggcgctagggaaaagggggttgaggagtttttgtttagtggatagagagttgcagttttacaagataaagagctttggagacagatggtggtaatggttgtaccacacgatgaatgcatttaataccactgaactatacacttaaaaatgtgaagatggcaaattttactctatgcatattttatcacaataaaaaatactgggaaaaaagacaatcctctcttccaattcttctaactactgcatgtaaaggaaaccaacagagacctgttttttaacattgtgctgagaatgaaatcgcacaggggactggggatcctgagagctgaaaactgaggcttctaaggaaattgggacttttccataaatgtatacacccagacttgtacatgaaaatcaattaaaagaaaaacacaaactatcccactgtgtcttgaaatattaggctcttcggagttctagggacgttgtttaatttaaatctggcatatgtgcgacgcttgcagttttgcccccatgccaaaatggcttggaggacatcagcttctgatgactgagcatttgtaaatctaaatctgtctccactcatttcagcttcagctccctcttctagagtggatgttcttaaaatttgattagggcatatcggagtcacctgaagagcttgttaaaccatgcagatcttcagacccctccttacagagattctgattcaactggctcagtggggctcagcaatctacatttttattagcacctattctgattcagactcaggctatgcttgagaagcattagcctagaaacctggggtcactgacgctcatccacctttggttcacaggagtcccacaaggcacaacagatctgtgcctgaaaaatcccatctctgttgatgtttacacatcaaacccttttttctcactgatttgtctgataatttctttatctccatttattatgaatttcaataaacagtaaaacttagctttcaagtttttctctgcctatgcctttcttcaaaaaattagggattccaaagacaagcatttggcttgtctactctgtatatgcctatcccaataaaatgtgtttcttcaactcctttaaaatagtagttctcagctctgttgcacaatgaatagtgtgttggacttctaaaacagtagttctcaaatattcgtgtgtctcaaaatcacgtggtgtggcgtgctgcggggaatgatgcttattataataaagattcacaggctccatagctagagagaaagccttgtcctgggcccaggaatctgcattttgacaggtaatcatgtgattcaggtacagttggtccattggccaggcttggaggcacccaattttggggcatgattctaaatcctttctgcaaaactgacagttgtttgcatatgtggtttgtctgagtcttcctaagtgtttgacacagataaaagaatctcatgaactagtttagagatcaaagaattcaaccatttcacttcttagatggggaaactagaaagtgacttggagaggtgacatgacttgtcccaggacacagctagctaatgctcgagtccagactcaaacccagctgggactgtcacttgacagtaatccaaagcctgtctggtgttcaggactctcccagaaaattacaacccacaatttcactgaccctggtgtgcatgcacgtggctttgctaggcagcagatgttactgaaacgtgtgggtggagcagtgagacccagcagctgagccacatgctctggatgttctaagtcaaggcttgctggattctagggtgttgggggaatgttcaaaagctgagcaattcgggagcagatgaggttaccttcttcaaccttccagagggatggaaccttctacagatgctggtcgtggtaaaggacgagaatgactttttttttttaaggctcggtggtaggtacaagaagatttcattgtattattattattccttaaacagcaatatatttcataatgaaaattttaaaaaggaaacaggagatgtgaaaaggaaggaaaaggcctgtgagtgtggtgacgtggacacctgaaagaccgcagtctcgtggtgggacgttgagaagacacaatcaacacaaagttgatcggatcttggtgtagctctgtggtggtaattctcatattctggttttcataatcatctgaggagttgaagtcatgtctcataccacccaccaagaaaaattccaaatattaaaaaatgcaaccaaaaaagaagaaaacacgaggtaattatcttgtaataaagaatgatgaaagacttttgaattacgtctcaaaattcaacagccataagcaaatggttgatatatttcactacaaaaaagataaaatctgcatggaaaaaaaaaagcaagctcaaaagactaaaaaagaaatagggaaaatatttgtaatcacatcacaaaaggctcatctgtccaatatataaattaataagaaaaagaccaacaaaccaatagaaatattaataaaagtaaaaaaggaattgccgatggctcttaagtatataaatatggccaaaatttactgagaaaagtgcaaatttatatctcagcatactttttacctattagcaaaattttgaaagattaattacacattgtattggcaaaactttggagaaataagctctctcatgcactgatggggtaagtatgaatttcctttggagggagatttggcaatatctgttaaaattgcaactgtgacccactctttcaagaaatttattctacactgaatgtgacgcaatacaaagatattcactacagctttgtttgcaatagcaaaagattggaaacaacctaaatgtccaacaatagaggcctgaccaaataaaatatggtatatttgcataatgaaagattatgactctataaaaaataactttatggctttttatgcattaatatagaaagattcagaagaacatattggaaggatacacagagtaaatgtggttaccatggaggggtactagatgaggaatagtgtgcagggaaaacttttcactgtttttttctttttatgtacttttttatttttgacgtatataaatatcttatctattcaaaatttaatttaggctgggcatagtgactcactcctgtaatcccagcactttgagaggctgaggcaggagaatggcttgagccttctgaatttgaaatcagcctgggtaacacggcaaaacctcatctccacacgaaacacaaacattagccaggtgtggtggtgcttgcctgtagtcccagctactcaggaggctgaggtgggatgattacctgagcccagggaagtccaggctgcaataagctatgattacactactgtactccaacctgggtgacagagtgagaccctgtctgaaaaaaaaaaaaaaatttaaataattaatcaaggagcctgttaaacatgtatgtggtttccccaaatattaactccaatgaaattaaatctccagtaatgataactgctgtgctttcatccctaagagtatattgaattattttttaaaaaatgacttgtggctgggtgcagtggctcatgactgtaatcccagcactttggaaggccaaggcaggaggatcacctgagctcagaagttcaagatgtgcctagtcaacatggtgaaaccctgtctctacaaaaacacaaaaattagctgagtgtgttgagaatcgtttgaacctgggaggtggaggttgcagcggggagagactgcaccattgcactccagcatgagcaacaagagcgaaactccgtctcaaaaaaaaaaaaaaaaaaaaaaaaaaaagacttgtactccttcagctctagtttctgagtttaaagtaacaatgcaaagcatcccccacatgggagattgagtatagaatgaatctgccatctgcccacgttttctaagatggatgttataattattatatggcttccagaaaccaatttgtacaatttatggccacgaatggtttccatttctctcctttttgctattatattaaaaaaaagattgaaaaagaaagaaaacaacccattttgtgctctggttaataaatggagggagagaaagccagctaggcatcaaccactgtctccaaccattatcatctgcatttgtgcgcatggtctgtccaaaacaacagtatatgttgattaaaagaccacaatggaaacaaacaaaaatcccaaacccatggctaaactgtaaagtcatcaacaattggtcttttcaggtatctgtgaaagtggaagacacaaatattctatggctcagcagttgcagtcttcggtgtataccaacagaaatgcgctcactcattaacaaaagaagcattattcataatggccccaaaataggacattacccaaatgtccatcaagattaggacagagacatccatgtgtgctgcattccagcaatgagaatgaaagcactgaaattacatgcaacaatcttgcaaacacaatgttgagccaaagacgacaaaaaagaaaagagtgtggctttatttctatgttaaaacagcaggcaccaagaatctacggctttagaagtgcaggtggcgggtggaagatattgactggaagagggtgtggggcggggttccagggagtgatgacctggatgatcagtttgtacgaagccataaagcagcatatttaatatttgtgaattttctgcatttttgttatacttcaaaagtttaaagaaatcattccaaaccagaatgagcactgtgggaatgagtttttcagaaatcatagacttaacttctgaataaatgctctcccagcccctgctgagatgccaaagacattccaaaggcacagactgaaaggacagaatgctcacagccaaaactaccgggatttctatgcagaaatctgggctttgatgctttagaggggcctctgtctccccctaccagacacaaagccagcagcaaggccttcacaatgggcttgccgaacagccgaaaaggaggttatttattaagccacaaggagaatgcacctacagtcatgtttccatgcaggaatctgtgacaactgaaatgccccatatgagctaattttctggataatcaaaatcccctcattaaacaactctgtcatttaaaataaaatcatttttattggatttaatcctttctaaaatggatttcatgcattcctgggtctacatccaggacacactccgtgcttcctacgagaatgattcctagcaagactttctcccagagagttccacatgcaagcagaaagaaaccaatgtgggctttagcaaaggaaggggtaggacagacgtctccattgtcagcaagaccacagaacaatggacttttcagaagagtccatggaatagaatctaacctttacaataaataacaacactcacatttaggtactgtctatttcccatccaaaaggctttccatcagattttctctcttaggtcctattattattcccatgttagatatgaggctatgaggtatgagaaactctctctccaaagcctaaactcctaacccctgtgctatcttttctttacatcttcagctatggagtctgtgttacactccacaatgccaacagacagagaggaatgctaactgtaacttgaatgatttgagttctcattgcttttctcccatcttttctttctctttcatcaatgttatacaattagttttttcataaagctcctactagcaagctactcctccccacactcagaaaacctcctacctaaaatctgataaaaatctttgttttcactactttaaactcttggccttcttggatctttctatttgttaaaatatcctatggagttggacaaacttctttatcagtttaagaaacccctctgtttctgtgcatttcaaagcatcctggatttgctttttcttcacccaactcagaaggaaacctgggatgctcattagattaacaaaaactgccctcaactggggcccatctggaccacagtcactctccagaaatacaatgggagcagataggaactgaggcatgccgagagtcaatttctgtaaggtttatcgctcgcagacctgtggtgaaaaggaaactgccatccttaccccgttttcaggctgaccaaggcgtcctctactcctttctgattaaatttggtcatgtactgatgcatgtagggatagttattccgaatgtttctctccgtgcttccattaggcactgtcccaaatcgaaaaggtggggaatagtcatgaggtctctgaaactggagagagaacgagaaaggaagagagagagtaggaaaagaaagagaagggaggagggggaggagagaacaaataataaattagtgatcattttgtctggtgttaggaggtaaatgcatgcattagggcaggatgacaataaaatgttgctttttggtctttctttctacttagtcacatcttcagccagtctgtgagctccaggagggtggacacagcatctgttttcttctgtactactgctcagatcctagcacagagcccggctgggtgctccataggtatttgttgagttgaacttttcagtgccattacagagactagcacagtgttaggcacacagtcagtacttagaaatgctgaatgagctgaacttaaggtactaccttagtccagtccatttatccactttatgatgaaattttctgtgatctccaccaatcactcccttctctaaactccatttataattaccttcacctcacccagaaaatgactatatattaccactcattcattctccactcactcagtcattcattcactcctgcaggcactatttatctagtgcctaacattccccaggcataattgccagtgcatggcaggctccatgaatacttgttgagccagagtccctgttgatctttagctatcagggatacgcagcactcggcactcaagccccccataaaggcctgtagtccatgcatcaccagtcttctctgatggattggatgattctgtctgtccacagcttcgatgtttcaggtgactcaatgagagtcgaatcaatagaactggatctgagttccagaaatacagctaaacactagagatggtggcgggctgtggttataagcaggagctcgaactggctggttggaaaattgggttctatcacatacaagctatggaaccctagataacacattcacttcatgctgcctccatttattttccatctgtagagtggggggccaccatgaagatctcaacatacatttgtcaagtaactggaatagtgcctggaccagagaaagcattcaaaaataaagctatgattaccgtctgttattatcattatgagtgaaaaaggaacctgaacctcatttttctatgaaacattgaattctggaactagaaagtaataacaacaatgactaacactttttgggaacctagttgggtccagcactatgccaagaactttacaaacgtcaggtcatttaatccttacaaacccatgccaggtagttaatcttagaggctgcttcttgcagataagaaaactgaggctcagagaggctatgtgatctatttaagattatgcaactaccaagcagtggcccagaattcaaacccggatgcgtctgaccacaggctgaggtcttaactctatcattcctcagagaccattgctattgactctctcctcatctagacataaagatttaaagaccccaggaggggaagagcacccagaaaatcagtgtcagaaccaggaccacaatgcagcagtctctccaacttccagaccagtgtgtcttccacagaactaagaaccgccagggtaagtgtccaaatttacccaagagtcaaaccagctagaaacattattcttttttccagactcacacttcacttcactgttaattaaaatttccagttgaaaatcgttttccctaaattaggcatgctgctgcctaatatgcagtcataactggatttgggagaagtggccatccattttccaaatgagatcctcctgccagggtgtgccttgccctgggagtatgtgcgtccacgtgtgcatgtgtgtgtatgtgaacagcaaaatgctttttgcagtcactccaccaagcagtgccttaactaatcaccaaaagctcaaaaggccaagcccaggctcatcctcatggcagccgcctgctcgggaggagagaggtaatagtgctgttcataaatctccttgtagcagccattcccaatctccagagatatccggagatggcctatttgactaaatgccttccacttcactccccgtctgttgcagaggagctgcataggtctttaaaaattcactttcttccctgtgtctgggttgcacagtaacagagatagatattcagtctctgtgatggtttccgtgcttctctggcctggatagtaccatcacccacacaaaattcagcctgacaccaagctccaggaaccttttccactagactgaagactgtcaaactttttaaagcatgactcacaatacgtttcccatcaccactccatgcacatgtgtgaaatttcacagcactcattctttctatctgtgatatactctgaggttatccattatgttctatttttttaaaaaaatgtctgcaatccttagattaatttcatggctcactaaagagtcatgacctacagcgtgaaaaacagtgagggggcaaggatggctcatctattaagtcccagggtctacatccaggacacactccgtgcttgctgcgagaatgattcctagcaagactttctcccagagagttccacgtgcaagcagaaagaatccaatatgggctttagcaaaggaaggggtaggacagaggtctccattgtcagcaagaccacagaacaatgtaatcacaatatctggagtcagaggaactcccctggcttctctgcagggttcccttgctgtgtaggttaactggtttcacctggctttggacttacaggagacaagttcaggttctcatctgctgcttagaaactgcgccatttggagcaaccagttaagctcctgagcctgaatttctctatctgtaaattggagattgcttttgcaacaaatcttatagtgtttgaaagaacacctggcatcctctaatgcttgggatagatcacctgttgttacccacgacatttcagccaaacaatgaagcctgtctccttacagtttggagaacagaggattattttctaattttttttccatccaatatggaggcatgtctgaaggtcatccaagtgactaaaacatggcaagtatttgatgatggaggaggtagagatgcaacacttggagataaaatttccagaaaaatgcagcaattaaccaagatattttttctttttttgtgaaccaaaaactacccatttattaaaaatatctatctgtcttctgtgcctgtaaataagggacatctggcaactggagcccctatttctagtacagtcttctgttggtgaagtcccacgtgcttcttgatgtgagcagcaagcaggtgtgtccttgagcagagagaggatcagctgggaggaggcctggctgcctgaactgggaccactcagcagcagcagcacagtgcccagagacagcatggctccttgagaacacattcctgggctcatccactgagagcagttgcctcaattccctccattggttgtcacaaaagaccaactcagtgcaataacatttcaggccccagaagccaagaatggtttgagtcaggcgatgatgaagatgatggaaggagtaggaggagaagggagacaaagagaaggagagggggaggaatgagaggggggagtggaaaggaggagggtagaagaaggaaataacacattacaggatcatctaccatgtgccaggcatggtgtgaggattatttctaatcctcctatcaaccttgccagaaaggagataatgtcttctcttttataggaaattaagcctaaggggatactgacatacagaaggccaatcatatggcaaggccaggatttgaacccaggtccatttgaccccaaacatgatattgctcttcccacaacataaatctgcctcccagagatggatttcctctgtcagagtgattcccaacattttggaaagcatccctatcaacattgcaattttctcttaataattcctagggaagcatcttacccatgaattcacctatttataatttaagtcccagctcatctgagcacaccatgggctccaatatgattatttcacagcaagcactaatggcttaaaagcattgtaaacctgagttgttacacaggtattcatgataaacaaacaacaaaaaaacaaaaacaaaaaacaaaaacaaaaccaaccacagtgtacaataaattgattcaatattgatttttttttgcagactttcttggtgtatcttctattaatcttctgggagcatataggttatttactccaggaattttgctgtttatctcattgtatcaaacatttaattaaaagagctatcagcttgcctctaatgttttcagcatggagactgagctttgtctcttgaggatatggtatctgttactgggtgtttccaagtcagtgaaggtcagtcaaattattagtggttttaattagttttcccacaagtggtcatgttatttagacccaaaactatgtagtaaggatttccccccgcccttgcctttgaacatagcaacaaaaagcaaaatatgctgccaaccactttcttgaaaaatcctctcttccaggacattgcttcctgctgcttccaccatacctccaatcacttctaggaattgcacttttgatcccataatgcgacagacttgcacaatagcgcttcatgtctgcagagggattcatatgctacaagatacatttacatatgtggctttctttcatccttactgcaattgtgactcccaaatttacaaagcagacaaagcaggcaccgtgaggtgacatggctttaaaaacattatacggctggctggcgagtggcagagaggaaacaggcagagaggaaacacaacttttctgactctaaacacagtgtgttatctgctgcctctgagataccacccgctttaggcggggatcttacagtagctgaccccaagtgaaggatttgggggtgagcatgatttactagtgaagggttccaggagaagtcagcaggggagcaggataaagttaggaaagactggagaagggggagaaatcaagggtctgatttaaggccaagtctccatctcagtcccgtcctgcagggagctccagagagtgattcgtaccttaaagtttttcctgcttcgaagcaagggagcagcttagcctttgtattctcacacagattagtctttggttacaggtgaccacaaagattgagggaacttaaattgccaggcatttaccattccagtgcccaaaggcaaaaatctgctgaggatccctgaagtgaggctttgtcagcaaagcacagaaaggtggggctgggcacacagcgctgcaaaagggatcccaggagatccaggtggggtatgcacagtgtccagtataccatgcatgtattcattcacccagcaagagtgtcctgagcacctccaaagtgcaaaataactctatcaaaactacatccctgagggcctcttcccccagacaattttagtctcatcagctttatcttctttataatacttattcctgccccaaatttccaaatttgtttcttccttgatgtttacttgtgtattgcttatttttttcctactagaatttaagtttcttgggagcctgagctcattctgccaagtttattacagtagccaggaaagacttccctgaggaggtaatgtcttccctaaggccagaaattccaggaggagccaaccatgagaagattggggaagaacattctaggcagagggcctaagaggcacaaggacactgagctgaaataaacttagtgacagggatggagcaagaggaaggaaacgtgggagcaggtgagataacacagggctttgtgtgccatggtaagtaaagtgacccttactcaagcctcaatcggaagccatcagagagaggtgaggcactctcatgcctttgtggaaatgactccatctttaaccccaacccctcatcagctctcttgacaagattctttcaaccacagtgtgtatcatggataagctgtaaaagctttccatggattgattttctattcagcagtttgttgatgaatggcaaaaggatatatgtagacttatgtcaaaaagatatgttagcgaggttttataacgagagacaaattatccccacacacagaacagaaaatctttgtggtgctgcaatctcaacacttgctgagcttagcaagtcaggatgtttcctgaactaaagtctcaataggaggatgcacccagtttacctcttttcttcctcaatgtgtgtttctgaatagctactcaaaccctgcaacccttgttatatttcatttcactggagaatgagagagcaggtgtttttactcctgtcttactgatgtgggaagtacagccctataagggaagattagtgatatatctgagtagaaagaaccagtgggaaattaaaaaaacagaaagaaagaaagaaaaaaactctctgctccttttgtgtgccttgaagacatttcaggtgagtcagaagcgctgatgctgagactgatttggctgtatggaaaagaggagctgtcagataattttgtctctgggtagggcttaaagatgactttttttcaggtcatagatgaggtacccacagcctacagtgctccttcaccccaatttcttctcatccaggaaaatgggccttccttaacatcacacattcgaaaggatgaatttcaacctaagcacttgagtcataggtcattcacaagcaccatcagaaagatcatataaataggaaacacgaccactcggggaagccaggcttccaaattagatctggaatcttttaggtctaggagagctaaccttaatgttctgtttcaaaaactttgagaaagaggacaatttgagttaaagagaaaaaaccttctggcttttgtgcattcgagttgatggatctcaatgagaggcacctgaatctcttcctcctgaaaggagagcagttaagaccaaccctcagatggagaggaaagcaaggtgaccttacctttttgtcactgaggccggtcacttggtccacaaattcctcttggatcatgaaggcagccagattggctgtgtagctagccaggaatatgacagcgaagaaggcccatacagataccatgatcttgctggtggtccctttaggattctggacaggcacggagttattgaacaccaggccccaaagaagccatatagcttttccaattgtaaaagaaggcccatggggtgctgcagaagatgaaaaggacattctcagcattttctgaaaaaaatgcctgtttgtgtatgacaaccacgcagcagccaccagcagcaccgaaggttgccagaagatggaattatatcatagttgtgtcctgtgattgccctagaaccacaataacttatttttttctttaaaaattagcattcttctcacatttctatctaactggatttttgccacatttctttaaaaaaagaaaggaaacgaaaatggttatgcaaaatgggggtttgaataagtagtgttatgacctgttttaaatttggatttgattcccatttgaggaaaccagccttcttaataaacataaagagagcctgacaaaaatgtgtgcatggggactgcttccaaattcatcggatgtgctatcgtataagaaccatgcaattcagcgggactgatgtttggtattctaatccgattgtccctagcaattgctcctgttcaaactcagatgtaaagtgtgtacaacataagaattaaaccaaactaaaaccctctccaaatggagacattaaggaatggaacaatagatcttaattcttccaacacttcacagatggaagacatttcattgcagggtcatggaaaatgaacactgatgtcatatcacagcactttttccagtatatcctcgcaatagctatgcagcccttttaagattcttaaatgttccttgcaacagacttaactaaagagacagaatgatatgccaaaatttatggcgatggggcatatgcaggctgtaaaacacacatattagggttttcaagtctttgttctgcatgggcaaaaaaaaaaaaaaaaaaaaatcaactgatgccctaatttcatagggaaggtttccctttaacaggaggttaatttttatgtcatttaagtaaatgaagatatgaaaaaatgatctactcagatgtcacctgccaatataagcagagtgggcaataaataaagtggcagaagcaaattcacattaatggaagttatgaagtgctgggcaggaagcctaggaaaagcaagctctctgcacattggaggccaaacccaggctacagctgtacttataatatccatgacacaacccattaaagagaaagcagttaattctcttattctcaatctctcctgtttctatttggctagttttgtgatcttctgggcttattctcaagaggcaggaaattcttggggaaaacttagagttaatccagtcaactttatgaacgatttagtttttttagggatgcacactgatcagaaatgacagctatttaggaatcagatgtaggcagttcagaaggatcggtccaagacttctaggaattcctgattcatgaatactatgactgggccatataacttttcccataaagtgcagcgaaatgtaacagaaaaccattttgtacaaagaaacaagtagctgtcatttcccaagagttgccacagcagatgagctggaaacagagagcctggagagaatggaagggctgaggagtttgcacaactgatgccatcctttacaatagtctttccagcatgcttcaggcaaaggagaacgtattgcaaggatgggctgtgggtggtttttaccttccaaaatgtaactcagatttacctgattatctgtattttcgttgttcttgacaagttccaagtcattgcagtcctttctcttggaaaagtgacaccttcttaactgccctccccgtccccgcttccaactgttgtccccacacactatctggatagagtagccccagtgacctttttgctctgtacatgtatgtcacctgtctccctgccattgttttttttttttcttttctttttctttttttttttttgagatggagtcttgctctgtcactcaggctgcagtgcagtggcacaatctcggctcactgcagcctccacttcccgggttcaagggattctcctgtgtcagcctcccgaactgctgggactacaggagcataccaccacgcccagctaatttttgtatttttagtagggatgcggttttgccatattggccaggctggtctcaaactcctgacctcaagtgatctgcccacctcagcctcccaaagtgctgggattacaggcatgagccaccgtgcctggcctccctccattgtattttgaagaaagtctgacatgcttcccatggtcaattgcctatctctctgatttcatcttatactattgtctacctcattcactcacatctttttattttattttttaatagagacagggtcttgctctgctgactaggcagtgcagtggtgtgatcatagctcactgcaacctaaacctcctgggctcaagtaattctcctacctcagccttctgagtagccgggaatacaggcacgcatcatcacgccaggcttattttatttatttatttatttatttatttatttatttatttatttatttattgtagagatgaggtcttgctatgttacccaggctggtctcaaactcctgacctcaggcaattctcctgccttggcctcaaaaagccttgacatcacaagtatgagccactgcaccccctcagcctttttctgtttcttgagcatctcaagattatttcagcctttctgtttgctgttccttttacatgaaatgactgtaactgtttttgacagataaaattgtatgtcacccttcaggtcctagctcaatgaacatcctttcccattggaccatcttatctaacgtagtgtctgcaccccatcactatcatgtcactatgtttttttcttcttcttgatatttattataatctgttattattagtttgtgtgtctacatgttattttcacaactaaattctaaactgcctgatagaaaatctctatttgatttaccacattatctctggcagcagtatagtgcctcctggcacgtagtacccatttgataaatattcatcagaaaatgtgtaaattcacaacagcacaagccctgattatgcaaatataaggaactactgtatcacagtgtggtcactcacagaaactgtctcagattccaccctgttggaaatcttcttagaggttaaattaccctttaaatgaaggcttgcaatctcccattaaacacaacatcattatttatggcattgtttagtatctggttgattgaagatggtttatgtggtaatcaccactcttcaatggtgaggaagaagttgaaagatttcaataaaactaggttcctaatagattcccatgacctgttgagtatttccaatattaaaacatctaagtgaaaagaatatgtatccatcacattaaagtgctctgctttttgggggatatgagacttcaagttccatcctctaccatatcaagtcattttttgggaaagagatttggtcctgacacttttctgataacacccatttagaaggtagtgcccactgaggaaagcccactcaaaatggcataacgtgtatgacataaaccctggctagagtgggatccttttaatgagttatagctaacgaatgcctcccaattttatttcctatctactgattgtccctttatcaactacaatgcactaagatcaatgcattttattttagcacacttgatttcctcctggcatcaccaacaggaaaatataaccctatggggaaatatatcacttcatagttatatttattgtcaaactaatgtaaattgattcagtagtttgaggaatgttcttaaactagattttataaagtcattttctttgcatagactgaagttgaaacccatgacaattttagcatttgacaagcattttttaaattaattgtcagaaaagttccttcaaatctgctttcccaacaaattgaacatcagtggttttcacctaacaactattgacttcaggttatgacaagattaaaatatttcattttgttttatccatcagttgaagtacataaaccatacttttctggtattacaagcaatatcagtgacccaaaaccattcatacaatggtacaccaacgcagtataatgtattctttgtgtgtgtgtgattgagtctcgctctgtccctcaggctggagtgcagtggcacaatctcgactcactgcaacctctgcctcctggttttaagcgattctcctgcctctgcctcatgagtagctggtattacaggtgtgtgccaccatgcccagctaatttttgtatttttagtagagatgggtttcaccatattggtcaggctggttctgaactcctgacctcatgatccacccacctcggtctcccaaagtgctgggattacaggcgtgagccaccatgcctggtctagagtaatgtgttctaaaactgaaattttcattaaaggtaaatgaaattgcaacaacattgaatcatgctcatgaaggtacccttacctttccctttggctaagtttctgttgtatccaacagggctgaagtattcaaagacaaaaacagctatggcagaaacaatgagcagcatcacaaacatcatcacccagacagaggcgctgaatggttctgcaaataaacagataaaggaatggaaacgtggttagttatctcttcctcacttccagcaggaagcccagacatccatttgcaggctcgccaaaaatattttctctaatttgaatctgatccttcaaaagaagctaatcattttttatttttatttttattttttagatgtagcttcactctctgtgtcacccaggctggagtgcagtggcacaatttcgacttgctgcaacctccgccccccaggttcaagcaattctcctgcctcagccttccgagtagctgggactacaggcatgtgccaccatgcctggctaatttttgtatttttagttgagacggggtttcgccatgttgcccaggctggtctcaaactcctgacctcaggtgatctgcccacctcggcctcccaaagtgctgggattacaggcgtgagccactgctcctggccagccagacattttttattcatcattttaaatcattctttattctacaaaatatttgaagtataagattgcatataatataataaaaatagagaagagcataggacattttacaaattaggtcaaggataatcagaagaaaaaagagtgataagaaagagggagcaagttagaatgcaaataaacaggccatagtttcctttgtaattatagaaccatccagggggctaaagctaggaagaaaaaagactagacccaaatagtaaaccataggctcctgcaaattgttatggtttttatttttattttttcatgctagaaagatgatatgcagggaattccaaaaataaagggagaattataacctgttggaaaagaattataaaatcatgggtgacagaaatattggaaagttataatctaccacactctccatttcaccttttgcctcagatagatgagattcctacagctttattaatcttgttgatgttggtagcagccttaaatgcaattgaaagtcaattgaggatattatcttcacatgataattcaataaaaaagcatcacttaaagggtagaggcaataaaatagtagatggatagatggttatttccactaaaagtagttttcatcagctcatttgcatgtaacttaggcagtaggtggatgtcttagaagggcaggccaagtcataaggctctaagccttgtaacactctagaaaggtaagaaatattatgtaaaataagattactattcaacttgattgaggatatgaaaattagctgactgcagccattttatttatggtatagatttgctataaaatcaacagaaaataaattttaaaaatgaatacatctccacctgaatgtatcatggggaagaaattgcctatagacaccaatgaacttaaaacccttttcctcataagcaaatattttctgagggttaaaataagtccaataatacttcttgaatagtaaacatattattattttaaaattgttttcctagtgaagctacttataataataaagagctaggttgatagcaggccaccttcttattagagtatgactacttaacacagctagaggtcaccacaaattccaatttaatgagtttaatgtataacaagaaactaatatgtccgaacttaactttagctatattggataatttaaaagctgggaggaatgctttctaatgcatttgatagtgcaaatatattaaaaagcaacaggtaacacaacttacttaagtaacacaagatgcgctccaagaaatcaatgaaactgcaactgaaatttattttaactttagcttgagtaataaacaatattatgtccctgaaataatagcaatttaatactgagttgtatccaaaaaggaaattagataaataaatgattaggagatttataagtacttcatattcaagaatagagataaaataattctccgagttgcgtagtgtgtcttattggaggaggatcattatgatgagcaaataagcatatacatgaaagtgtttgttcgtgtgtgaggcacacaatatacagacaatatactgagtggaatagctgtgtgattccaggattaaagccagaaatactggggcaacaatacgctgtccatggttctgaaaagggcgtgctggtttttgaaaaagcacatttattaatctggtaacgtctatttctctgcaggctgtgaaaacattatttttaaacattagaagggaccataactgaattatcctatgtgcatgtaagaatctgtaaacctgcagtgaactttttttggtaggtgcatccttgtcactaacacgctagtcagaaaatcaagtggaaactgatgaagcaactgttcccacatgtctccccacttggaattgaccacatctgttccttaacttgtgagcacagcacggatcaaaggactctgctgcagtagtcttgttttagtaaattaagtacctatcagtgccctgaagggttgctattctaagataccacacacgtgaatgcacacacatgctccagaacaaagaaacatcgttaaagcaacatctatagtgtctaaggagtgacccagaaatagtttagataactctctattacatcttctaatggcttaaaacagattcaacatttgtccatgaaggaactgcaatcgaggagataccaggtcagcatttctttggatcaaagaatccaacttgtttggaaactcttcagaattaactagatagaaatattacaggagatgccatctctgtccttgaagagccactggttacatttttacacaaaagcttagaggcattacctgcaagtgcttctgatgtgagttaatggagtttgtggaggagagaaaataggaaataatgaacagcaataaaatcagattttgaatgttttggctcttccagatgactaagccagtgaatggaaaaatgtagcttagctggttcattatgactttcaaaatctgtagataatgaccgtaaataagggggtgcacagtcaatcaaatagggatgtaatttagtgactaggaaaaatattaagcctactgggtaaaaacagctttgaaaatagtttcctctggttacaatttattttacttttaaaaatgcagcaggaaaagtgtggggaaagagaggttttgctaaatttagcaaaatacttgacatttttatggaaatgttttacaaatgcaagcaagataaaaatctagagaaactgggttgaggccagattcaatattcacgacccattttcataagacaagccaattgatatttttttctctctgattgaattggaaaaagagttctctctagctcactaaagagatacaagacttttttgtgtgaaaagaaacaatttctttccattttgatccatgaactcacttcctctaaccctttcttaacctccaggacaaaggattcctgccaaagagtctgaaagggaatgaggggaaacatgactaggagtgactaaagagtgaatgtccacttaagaattattaagattctgcatgtgttgtcaatatcagctggttgcattgttcctggcatagtgaggctctcttattaaaatacgagtatctgaatccatgtcagacggagggacaaaaggaacataatgaggtgtgtatttgtcagggtccacattactccaacaaaggttacaaaaattgaagcaacgagtgcaaaatcaaatccagagagtggcaagcattttaacagcttaaatggattatcaaaaatgaaaacagtaaatccatagcgctctgaatgtaaggcagtgtccaaaatcctgttagtcaatatttcactgaagagaacgaaacatgaaagtttcactggatgccaacattacatataaatgaagacagtggaagaataagacaatgggcttggagttggtgtccacaaattggtttcagtttacaatttgctttaagagataaagttatttttgtctctggaaaaatataagaaagttagttgactttaatataactgttttcccaggggggagatttctcaaacaactaaaagtagatctaccatttgatccagcaatttcactactgggtatctacccaaaggaaaagaagttattatatcaaaaagacacttgcacacatatgtttatcagagcacaactcacaattgcaaagatatggaatcaacctatgagcccatcaactgatgattgcataaagaaaatgtggtatatatacattgtggaatactactcagccataaaaaagaatgatgcaatgtcttttgcagcaacttggatgaaactggaggccatcattctaaatatatgatagtcatctagcaaataaatgactgttgttctttgtgagatggaggatgggtatgtagatgctgaataaaggtttatgggctgatttaaattaactgtggaccgacaggtttatttttaaaatgttttcaagactctaagcaatatagctattaatttacattccacagtgtcaagaccagtatctgaatatgtgatcttatttttttagcagctttttctaagtttgagataaatgaaagatgtgaactgggggatgggtttttcaagaatggaaaatctaatactacatattctcacttctaaatgaaagctaacctatgggtatgaaaaagcacacaagtggtataatggacactggagactcagaaagggagaggatgggagggagatgagtgatggaaaattacctacaatgtacactatttaggtgacaggtacactaaaggcccagacttcaccactatataattcgtccatataaccaaaaatcacttgtacccctgagctattgaaattttttaaaaattatacatatttttcccctctcagttttcctccagagattcacgtttgtcttaaccttccctaatttgggacaaacccacttatatgggagtgccaagggggaattagtgatctgaatttcatgatattcaacaagatagttacagtcaaaactcatttatgataaccaaacagttaatacaacactttcctttaaagacaaaaataatgctttactatgttccatgaaatttcaactctagccaggctacccaatacagtccaagtgctagagaaaagcagatgatagaaaacatagctcttccttgatttaaaaaaaaaaaacaccttttatgtaaaaacataaatttacaaaacggttaaaaaaatcacaagaatttccttctttacaaactatttggcttaatgggtagtcacatttaaaatatgattcgattaattttaaatcagcatatacttttcagactattcctattagcagaatattggcataaatcatcgtgcagtcatcattattttcactcttacatctagcaaataaatgactgctgttctttgtgggatggaggatggatatgtagatgctgaataaaggtctatgagctggtttaaattaactgtggacagctttatttttaaatgttttcaatattctaagcaatatatctattaatttacattctacagagtcaagaccagtatctgaatatgtgatcatatttttttcagcagctttttccaagtttaagacaaatgaaagatgtgaactggggatggaggggagtgaattaggatgtattagtctactctcacgctgctataaagaactgcccgaggatcacttgaggtcaggagtttgatatcagtctggccaacatggcgaaaccccatctctacacaaaaattagccaggcatggtggtgggcacctataatcccagctactggggaggctgaggtgggagaattgcttgaacccaggaggcagaggccgcagtaagccaagatcataacactgcactcaagcctgggcagcagagctagactccatctcaaaaaaataaactgtctgagattgggtaaatttataaaggaaagagatttaattgactcacagttccacatggctggggagtccccaggaaacttacaatcatggcagaagaggaagcagacacgtcttacatggcggcatgtgagagaagtgaagcgaagggggaagagccccttattaaaccccttataataataataatataatgagagccccttattaaaccgtcagatctcatgagaactcactcattatcacaagaacagaaggggagaaaccatccccatgatcccgtcacctcccatcaggtctctccctcaacagctggggattacaattcaagatgaaatttgggtggggacccaaagcctaaccctttcataggataattcaaatgcagcatcctctgaaatatgctgccatggccaaacagagctaaacaagttcctttctggtcccatcctctgagcaaacaagatttcctacaattccttataggaaagcaatagtcactatgaaattcacacacctagaaaagcagaaggtgagacggtgccattacttcttgaaaccatgacactgattcccgtttccacaaagggcacagagaagtccaccacttcagaacgttcctcattgatggtgagcgagccaactgccatgactgcccgttgatagaccacctggatgcaaggcaaaaaaaaaaaaaaaaaaaagagagagagagaacaacagtactttacttttcctgctaacattcctgaggactgcaggccctttgtctgagtaagagcctaggggatgaaaagataacttacttcaccgatcattccattccacacattgttaactttcttgccatgcttcccattggtcaccagatagaggtcgtaagtaaacttcacagttctggaaagcttcttcagaatatcaatgcagaaccccttgcagcatttcttcacattcatcccctcattggttgaattgctgtaaagaaaaaccccaagaccacagaatgttagcactggaaggtttgttcacaatcattagctgtactcttctcctatttttcagatgagtaaactgaagtttaaaaggggaagtggctttcccaaggacacactgtgagtacatgacagcaaaagcagaaagtgtccttaattatagcagttatcatgacaagaactaacacttattgagtaattactatttgctaagcactatcctaaaggcttcatactaattgttgaattaatcttcatgacattttctgaattagttgatatttgtacacccattaaacaggtaaaaattaccaactcttaaatttttaagagtttataacatacacaactttagactagagtttagtcatcagatctaaactgagtcataaaaacttactagagaatggaagagaggaggatgtgaaattctcagagaaagcaaggttttgcttcattctataattacagaggcttgaaaccaaaggggagaagtgaaggtacccagacaacacctcagccaagaatcaggagacctgggttctattccatgcctgattttgtgcactgaacttctcttgatagagccaaatgttacatgagggctcattaataacatcttccctacctacctatgtgacatgtagtataaaaggagacacttctaaaagcaaggtccttgatcaggtaaagaccccattaaaatttaaactatcttaaaggctattgtatactctaccaaggctacacttactgttttgtaccagccaccttgctgtattcacctgaacaagacatattcaaaggacacccaggcaaaccagaaaaatacctttaaaaagaaaggaggccgggtatggtggctcacacctataatcccagcactttcggaggctgtggcgggtgaacacctgaggtcaggagttcaagaccagcttggccagcatggcgaaaccctgtctctactaaaaatacaaaaattagccaggcatggtggcaggcacctgtagttccagatactcaggaggctgaggcataagaatcacttgaacccaggaggcgggggctgcagtgagccaatatcatgccgttgtactcaagcctgggtgacaagagtgaaactctgtctccaaaaaaaaaagaaaaaagaaaagaaagaaaggaaacactggtctatccaacggatagcaaaaagtacttagacaattcacataagatcaaagcctttcttctgggcaatatgcttgattaatggacatcccattagctcaaccctgtctttgagttatgcatttcatgaatatgttctctgtttgaatatcccatttttggcaaatccacacattggagtgttacctaagcactaaagtgatgtctatggaaatccaacatcatcacaggaaaattcttatgcttccatgtcatatgaaaaaagtaggttacacagtagtacaaacagaataatcacagctatataaaaacagatgagcttatgaaataactgtatggaaaaacaatgaaatatgaagcataggacaggtgcagtggctcattcctgtaatctcagcactttgggaagccaagttgggtggatcccctgaggttgggagtttgagaccagcctggccaacatggagaaaccccatttttactaaaaatacaaaaatgagctgggcatggtggcatgcacctgtaatcccagctacacaggaggcataagaatagcttcaatctgggaggtagaggttgcagtgagccaagatcgcaccactgcactccagcctaggtgacagaatgtgactctgtcgagagaaagagagaaagaaagaaagagagagagagagagagaggaagaaagaaagaaagaaagaaagagagaaacagaaagagaaaaaggggggagagggagagatagaaagaaagaaagagagagagagaaagagagggagggagagagaagagagaaagaaagagaaagaaataaaggaggaaacgaggaaaggaagaaaggaaagaaagaaagaagcaagctattttggaacggtgaaaaacatgttttcttttttacatttttagggtttttccccaaattatctagtaagtacatactacttatgtaattggcaacacagacacacacacacgcatcaaacaacattgatttacatgatatacatcatctctatatccatgaaggtgggcagatttgacagaacaattttttaagagacacgctcttgctctgttgcccaggctgggttgcagtgatgtgatcatggctcatggcagactggacctcctggcctcaagtgatactcccactttggcctttcaaagtgctgggattacaggtgtgcgacaccatactcaagctggaaaacataattttgagtaacagaagtgggttgtaaatgacacctgcttatcaatgctttcctttatctcaggatcacagactgcctgtcttgaatcactctcttcaccattgtatcccacccccacatcctgtcagtgacttgtactcaaccactctgcttctgtcaacccagaccaccatagagactttactctcttgcctagaggctggatgacctgctgtcatccaccacccttagtgggggggtagtaggaggccacatctgtgtatatttacatgtgatgattagtgacctcaacactgtacagtcatgggatatgtgccagctccatctccaccaattacccagaatggagggggttgggctagagttaaaactgccacaaatatgatagaaatgtgtcctaagtacattaaagttgatggaatgtccagataccatttccttcttagtatacatggctctgaaaaatgtgtcaaaatcgaattctctttttctttctggtcgctgttggccatgcactgatgccctttccctacctctgttcatttgtatcaccttcattctatgttccttcccttcttcccctatcacaggctcttccttcacctggtcaagatttctggaagattagagagaagttttaggtgccccaggtttaagattcaaggtcacaggcatatagtggcattctttggtctccctggaaacctcagccagtttatgagttatctcacccatatccctgaacatgaggtatatttctaaatacaaatgatcaatgacgcattttcacccaacaagcacccactaagtgcctactgtgcacaagacatggaactgggccttggggacacaggatgaaaaaggcacgcagcaaaggcaatagttgaatttatcacagtaattatggaattgcagaccagcttgtaattgggaacgtctgttggttcctattacagcccttgtgtgggtgtgcaggggatgtgacttaactacacagactgagaaatggtccccatgtgatctctcttagtgctccaccaccacccaagagagggaatgactcacaaaaacaaatacggggaaagggatccaacaaattgtccagtttaccagctctacaatttcccagtatagccggtggatgtgagcacagccatgcgagtcagagctgtgtccaggtcctgggttggctcctgtccaccacgcagactcagacaaatctcatccagcacttaaaaataaatttcctttcttcccaccaatgatttgacagtttgggagcttaattgacagcatggccatttctcgctacacatcaggccaaatgatttttccaattttctctgcatgtctttatcacccaactaacagaccagaaaggaagatttctcagctcatttccggttacctggtattcttagaagatcccaccacttgccagaagtgagaaacaaaaaggtttcacacaatcatgttgtctaacaggaattctttttgcaactgatcagccttcctcaaagacgttccctataggaaatgcaattgatctaatcttctttaatgttgggattagtggatcctagcaattctctattgctctcacgagtcagactttcatttcatccagacacagtaaactcctcatatccccaagcggaagaaggaaagctgcaagctactatctcctcacagaaaccaaaaacgtgaatttgaacctgttaagctgttgatagtcttcagtagaaaagtcaattcttttaaagacagcaatttattttgatttctcttcctcatacaaatgtgactcagtacttggggatctacttgttttcagctccagggcttttgattttaaagactctaaactcctattattgattctggagcacacggggcctcagttgattgccctattgaaacacagagggtattgttatcataggggaggtgtcccactgaagttagactctgctttgtgccagccactttgctttcttcatcgggccaagttctgctcaaagaacacccacccaaattagaacatcctctgacaactttcccacatcatcccctccatcctccttgtaactcatcactctctagcactgcactgggtttcattccgtttcccaaactcccaagctcctttcctccccagggcctttgcacctgccattgcctctacctggaaggctttgcccagatattcacatgtctggcttcttctcatcctgtatatatcaccttaaatcttatctgtgtgagctaaagtaaccccacataccccgatgtactctcttctcacaccactctctttctgttcatcacaaggtttattacaacatggggtcacccatttcttcctggtcgaattgttttctaaccacgtaagttccatgatggaaaggtcctagtcttttgccctccctgttcatccatgtatcccctgtgcccagcaatgtgcctaacatgcaaactgtgcttaatgcacattcattcattctgtattaaaacaatttatttataacaattttacttataacaatgtctgtgttatttcactgtaaaggaattcagcaaaaatcattaaaacattcctgaccccaaaacatggtctgtttcacacaattatgaatcatgatgaattatgaatcatgaatcatgggatgtacacttgcccttccttggtgggccccacctcttcctcatctccaggagagtggaggctgggggactgcttatcaaaaaaaaacttcatcccagggagccacagtggggacactggagaaagcaagggcctttttaggaggggcatatttatttattccatgatgtattcaggatttcaacttcaaagaggctgacatttgtgacctcactgataaaattttctccaaaccaaaacaggccttcacaatacatttagcaatcacatattatatctttaaaatcctgatctcaaggactgagatctgggcacttgcatcttgtgtgataatagctgagactggagtttgaaacgaggaagtaaaaatctctcttcctagtcatgaaacaaacattggtgtgtcatgctgtgcccttgtaactgagggtgcaaatattaataagtcacattccctatatgtaggtggctcagaagccagggagaagacaaactatacactgtaaagacaggtgatgagggtagagagagatacacccaggtactgtggaagtaggaagagctaacccagcttggggacgcaggagctacacttaaaggatgagtaagaattaggtaaaagaaacagatcagaaaagactcagaaaacaaataaagtttccaacagcaggcctttttcttctgtgagtctcctgtgaggtggtgtttttgcttatgtttgcattaggaaataccaggatcagggccttggaggtggccatggaggtttctgtgtccccagagggtttgtagattaaggggacctcataatggacaatgccagctctttcttcaatcataacaaaaggagaaatgacacagatgcagtgcctgctggctgttgctgagctgagaaactgccagaagttccatttgcacctggattgtatcagaaagtaacatgcaaggtgtgtgttcactcccaaatggagagacgtttttaaccttcttgagaagcatagatctgggatctataaaagagatggaagaagaatgtgtggggggaaggaaagggacagccagaaaagtggaaactaaataattatttttaaaaagactaaaggaagccggacacagtggctcacatctataatcccagtgactcaggaggccaaggcatgaggatcacttaaggccaggagcttgagaccaggctgagtaacatagcaagactcttgtctctaaaaaaaaaaattaattaaaacatgagccagacatggtggcacaggcctgtagtctcagctattcaggaggttgaggtgagaagaacacttgagcctaggagttcaagaatgcagtgagccgtgatcacaccactgcactccagcctgggggacagagcaagaccctgtcattatataaaaaaaattaatgttttatatatttttaacacataaaaatatataatgttttatatatttttaacacataaaaatatatgttttatatatttttaacacataaaaatatatgttttatattttttaacaaaaatatgtaatgttttatatatttttaacacataaaaatatataatgttttatacatttttaacatataaaaacatacgttttatacatttctaacataacagtaggggcatatttatttattccatgatgtattcaggatttcaacttcaaagaggctgacatttgtgacctcattgataaaattttctccaaaccaaaacaggccttatttttatatgttttatatatatataaaaatatatatgttatatatgtttaacatgaaaatatatggtttatatatttttaatatataaaaatatattggtttctatatgttaatatatgaaaatgttttatatattttaacatataaatatatattttatatataaacttgtacattaactatatattttatctataaacatatagtttatatataaaaatagtttatatataaaatatgtaaaaatatatgttttatatatctcaatatataaaaatgtataatgtttatatatttctattttcatttatttatttatttttgagtcagagtctcactctgttgcctaggctggagtgtagtggctcgatctcgacttattgcaacctccacctcccagattcaagtgattctcatgcttcagcctcctgagtagctgggatcacaggcgcccaccaccatagctggctaatttttgtacttttaagaaagacagggtttagccatgttgcctaggctggtcttcaactcctgacctcaagtaatctgcccagcttggcctcccaaagtgctgagattatagatgtgaatcactgtgtccaaccatatgtatttttaatatataaaaatacgatgttttatatttttaatgtataaaatatgatgttttacatattttaatgtataaaaatatatgatcttttatatttttaatatataaaaacatatggtgttttatatatttaatacataaaatatatgttttataatattttaaatatataaaatacactgttttataatattttaaatatataaaatacactgttttataatattttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatatactgttttatatatttaaatatataaaatacactgttttatatatttaaatatataaaatatactgttttatatatttaaatatataaaatatataatttctatatatttatatataatgttttatattttaatatattaagatatgttttatatttattttaatatacaaaaatgttttctatattaaaaatataaagatattttttgaatatgtatgttcaaaaataaataaatgaataaattaaattaaactagaaagactgaaggggaggattgattcaacctaagggttaaaaacatgtctgtggagtcagttggaccactgtttgagtcctacctcttccatttcctagctagatggctttgaacatgtttcataatcttcccataactcggttttatcatatttacaatgggcaaaactactcacctcatattgctggtggaattaaatgaatgcaagtgtggcacatctctaggaatttatctaagtcttttttaaattgattattgtattatacctactataacgacgtgtattttctatgacattttgtgattcaagtacacatattgttactatcgatgatccatgctatttcaaagggttgggcacgttcaggtgacagcattcctgccactcacttgattttgacgaacttccgacatggcacggtgttcctcacacacgtctcggtcagggggtctatgtcttccacgatgacgaatggggcctcctccagggtgacgatgctgagatggttgtcatccggctcacagtcggagaaggacttgtacctgggccacacggcgtgcctcaggctcagcgtatggttctcccacttgcccacctgcagcacaaacacaaagacacagctgtgctttcttccgccgctgatttctggagaggcaaatcctttccctgccagagacatccatccgtctcaagggcctttctgccacatatctcaacatatgcatctacttctgtgctaagacaaacgggcataaagagaaaacagaatatagggcagttctccatcccagccgccctcatccccagaggaatcaacctgcatctctggaggcagtgcccaggcactgatacctttacagccccgcaggtggttctaatgttctgccagagttcaggaccacggatggcaaggaaacagcatagacttttagaatcagagaggtctgggtttgattctcccactgtaccacttactagctgtactaggcaagctcttaatcctaagatcttctgttttctcatctgtataatgaacacaattccccctacttcctaaggatgccatgggaattcaataaagcaatgcatgaaaggcaaaagcacaacataggtactccatattgtttctaagtataaaggagagaaagtgaaaaggagaaagaagaaaaaggtgctaagatgaaggaaaagagaaaaagggagaggaagatgaagctagagagtgaaaagaagaggagtgggggttgagacaacacagagaagagatggagcaggtggggaaattaaaagcatcattttgaccccagatacagttctatttaagttgcaaattaaggtgaacttttattaatcctgcacagaggggagactgtcactgcttagcgtacatcaagacctgtcaaaatagaatcgattgtattccctcggagcagcagtcggcatcttagtgcaatcaaattgaaggctgtatattttgaaccttaattttatttgacagcttattggcgctattcacatacacgctgggaggaagctgcccccgcaccgctctttctcccttctcctcctgctcccacacgccattgcttgacaccacaggtcaccgctttatttgtaataccaacctcgaggaaaacacctcgtgtgaaaagctaagtgccaaatccaggcttgtctgtgttgaccagacccactcacctctcctcctgtaatgtttaagtgtcaccagaaatgaatctcaaacccttaaagagaattcaaacatgccggacaccaggagaggtgacagggtgggaggagagaaaagaatcagtgctctctaagattacctcatcatatgggctggaaaatttttgctggctataaagaaacatttcctgtggctaattacaaaattgtccagcattgctgatacatttctttttaagataggatggcgagtagagcaatttggttaaacacacacacacatgttcatttattcacgctatgatatgtaacaggctggggagaatgctgagcgcatcaaattcttcattcattcgacatagatttattgaagacctacgatgtcccagtgccagcctaggaataatgatggctaaaacagaatgactcttgccttcttggaactgtcagtcagttgtacgacatagatcaaaccaaaaatactgaaatatgcaaatagataaagaaatatacaagtgtttccttttggaacatgttataccaatcccttttctttccatttgccttggaagactcaaacacaaccttcgagagagggtgggtagttcagtgggtaagagaatggcttttgaagtcaaacagaactaagtgtaaatcctggcttcatccactagctgagtagccttgggaaagtcattcaacctctctgagcttcactttctccatttgtaaaatgaagagagcaacagggtatgaccttgaagactgcagtaaggtttgaatgagccaaaaagtaccaaaaatatagagcacaaaacctgacatggcatgtaacacatatggtggctgctattattttactattgttgttaacatttaaaacataactgaactgtcaccttacctgtaaaatcattcctgctttccctagtaatatagaactttgcgcatatctccaccgtagcattttatattataacctcaatgacataacttttgagcactcctgtacagtcaggaaatgtgccaatatcaccacttagtttaattcctacaaactctacatggtaagcattattattccaacttcgtagttcaggaaactgaaacacagagaggttatgtgacttgcacaaactcacacagcaataagtggtggaaccagagttataacgtggggctttctgaacccaaaggtgctttctcgctatgtacagtgtttctgtgaattgagctacagtaaccacgttatagctccaacactcttccttccttgcagacatgtttcctaaagtcccaagataatgtaaattaaggcaaagactagcagaatctttggtgatgtcattgaccacatcacaacccccacaccatgggagtcaggcaaaagtttcagtccaacgctcgctcatggagagaaaagttgcaaaggtttatgagcccccagagtgcaataacttcctaaatcttctccaagttctactccctgttcctgacacatccaagtatccatgggtcagccaaggaggttgaagatgagtggtaggtagagagaactcgatcaggagctgaagctgctgtgtcaacactgccctaggtcccaagagctcttaccttcttttctcatctgatagacccttcggcaccccactgcaaacaccaaaaatctcaactactaaatcgtatataccagataaaggagaacagacattcttcactttccctgcctatattcctatttacaagggactataactgaggccagtgtttgtagacaggtttagcagagtcattcattccataaatatgtgttgagtggttactaggttccaagcactgtgctagacactgagaatactgtaatggaagtgataaaatgtttgcttgcatgaaatttttgtgctaattgagaagacacatgagtcaaatgattacacaaaaacatatgttcatacaaattgggaggaagaaatgaaacatgggtctaagagagcatataggagaaaagatatcagagacatcttccctgaggaggtgacacttaagctgaaattggaaattcaggatgagttgcatcgtggcagttgtgggaaggaattgtggaggagcagagaaggaaagagcactccagataggtggagaccagaaaatgcaaagccttgtaggctctattaagaagttgggatttaccttaagggtttgctacagactgaatatttgcgtccctccaaaattcataggttgaaatcctaacccctaatgtggtggtgttaggaggaggggtctttgggagctgattaggtcatgaaggtggagccctcatgaatggggttagtgcttttatgaaagaggccccagagagacccattgccttttccaccatatcagtatgcaacaagaagattgctgtctatgaaccaggaagcagctctcaccagacgctaaatctgctggcaccttgatttggacttcccagtctccagaagcatgagaaacaagtttctgtggtttataagccacccagtctatggtattctgttacagcaacccaaatggactaagagtcaatcaagttcaatggccagaatggaaaaagatttatagaagtcaccatggatatatgtccatatataacctgcctgaagatggaagcttctttgcctactccaatttttttttaattatggaaatgttcaaatgtatttaagagtagaatcatataatgaacctccgtattcccaatgtccagcttcaataattagtactcatgaccaatcttgtttcatttatactcccactcactccttctatattacagcaaaaaaacccattatataatttattcataaatccttaatttgatttaaatatctaaacatcatttgcttcacaatattatacctcaataatctacaataatctatgtgtttatgtatatgttttacttatgagactatgatttcccagtctaccaggaattttatatgcgtaatgattggtttctatgtccacagcttctaactcagggcatgccacatggagggacttaatgggtagtttttggtggagtgaataaacatacagcctgtattttttacatgtgcatgagtcagaaagtgttagaatgattaatgtgtccatatgtgcctcagctttggaatcttgtaccctaggcaaaatatggaagtatcaaggacctgtattctctcccttgctcttactgcaacttcagcccccgagactcagagccattgagggtggccgtctgaatagcctttgggtattaaatttccccagagaaagcaaacagcatcatcctaacaccattttaaaaagggactccagccaccagagtattcagggagaaagaaagaaccaatgggttgaatcctgaagacctcagtttcgactgtcatattgtttctgcttgtctccatttccacagtggcatggagtatgtatgctccaaatgcctttatttagaagttatatccaaaatggaaggaccctgtgcactttgaagatggcagccaaaaatatctctgctcccaccttggacgtgatggtgactcttctgctattctctaaactggacctttttcctgttcccaatcctctccataaaagtgaacaccacactcagctgagtctgtaactttagatcagcattcctgactcataaaagctattctgaagtgtgagccaataccagggttgcaccgcatttcctccagcagtgcttccaggagtaaggtttcaatccatttcctccagcagtgcttccaggaataaggtttcaatgcatcagagcaagtgaaatcatacagtccttgtcaatcacatgctatttttggagcttggagggaaaatgaagttccaggacaccttgccaaacttctggttatatttatacacaaccaggacaggcaagcacgcttgtgtgtgtgtgtgtgtgtgtgtgtgtgtgtgtgctgtatacatgtacatgtatatgcacatatggatcccattgagttttcaggcatcaacttcattgctacagaacccctctcttctctcctttacatggcacaggacaagagggttcagaatcattaatagcacaggcttagagatcagacagatgaacaggttcaaatcttgtcactgctttagccatgtgaccttgaacaagccacataatctttttgaacctcagttcactcaatcaccaaataaaaacaacacttccatttcatatgctgttatgaggcttacttataagataataacaacaaacatctcttaatgcacagttcctggcacacagaaaggtctccatacgtggaactattatcattaattcaacatttgttaaacttatcttcaggaaaatgagcctctgtagcagaagaactaattgacaaatggagatctgagtttcttcaatggcattcccttgacttttgacctcactgattgggtgtcattctcctcactgtaacaggaatgaggggagtgggtttgaatcagataatctctaaggtctttcaggtatagcactctatgtaaaatgcaaggataagctgccctcccaaatctttcctgatttgagctcagggtaatgagtacataattagaagaggggcaaaggtggcactccttacttgacatttaattctgtatggcaaccatatattagggcagtcttgcacccagggtgaaaggacagcagaaaacagccaaatggcaagctatctctaaaaaaggtggcaggatggttctgagaaccagttagaagactgaggaaagaagaacatggtcaatagagccctcttggatagtaattctccatgctgcacaaaaaacagtggtactcaaatctgaggcttttctcaaagctggctcttcctcattctctaaagaagggcatgagttcaaatcctgacttgtccattcctagctggggcacagtgggcaataatgacaaagaccattgttaacactgattagggctttactatgtgtttccaggagcagtgctaagggtttttcattcattatatgactcaatcctcaaggcaactgtaggacatagataactataattatcctcattgcatgatgaggaaaccagggcttaaaaatattatgtttcttgctcaggtcagatcataaggctcacagtaagaatttaaacttagtcagtgaaaacctctagagcacagcttaatcactacctccctttttgaaatttagtttcttcatattttaaaggttacaacaaggccacagagttgttataaagattacataagattcacgcctgtaatcccagcactttgggaggctgaggcgggtagatcacgaggtcaggagatcgagaccatcctggctaacatggtgaaaccccgtctctactaaaaaaaaaatacaaaaaatttgccgggcatggtggtaggctcctgtagtcccagctacttgggaggctgaggcaggagaatggcatgaacccgggaggccgagcttgcagtgagccgagatcgcgccactgcactccagcctgggtgacagagtgagactccatctcaaaaaaaaaaaaaaaaaaagattacatgagatgataaaaataagtctttccgtttctactattccgaaagctttaataatttctgtaatcctaaaaatagatacatgaataacatgctacttttattatctccatttcatagatgaggaaactgaggcatggggtttaagtaattgtccaattcatatggcagaaccaggatgtgaacccaggactcatttttaagtctgtgaaaaaatgcaactagaattttctgctgaacaaaaaaaaaagactaactttacaatgcagaaatgtgacagatgtgatgtcagctcaatggtcaaagccaatatggacaatgataaatcattctaatagtacatatccttaatatgatgtgatgataatggcgtggtgttctacctgtgtcgtcttataacctcggtgtaattataagaaaactatcagaaaaattccaatgtaggggtattctagaagatatctgaccagtagtcctccaaattgtcaaaggtcattaaaaaacaagaaggtctaagaaagtgtcctagtcaagaggagcctaaggcaatattacaattacatgtcatataggatcctggatcagctatcaggatggaacagaaaaagattagataaaaactaaggaaatctgaaaaaatcatgggttttagttgacaataatatacgaattgactcattatgacaaatataccatactaatgtcaggtgttaataatcagagaaactgggcattaggtatgtgagaagtcactggactatctttgcaagttttttgtaaatataaaactagttaacctaaaaagtttattcaaaaactgtttttgaattcaaaagggagagttttttaaaaacagcaaatatgttctcagacacagagtagcaaagttgccaggagtttaaactttggagccagccactctggcttcaaatcccagctgtaccacttgtgagctgtgccacttgggcaaatttcttaatatctatttgcctcagtttcatcacctgaaaagtaggatgatgttaatagtataattcacaggattgctgagaggactaaattaatgtattaaagcccataaaggaatgcccaatgctatgtgctatgtattgctattttgtcattgtttaaatcaatggggaaacaattttagagtagaatttagattatttcatgttttaacttcataagagcttttctcgatactaactttagtttaatttagacacagtttttaccatgtcagtagttttagccataaatcacgcttttctccacatttctcccaagggtttcacaatagccttatgctgttttgcttacctgtcattcatttatcagatttttggttatagcatattcattttcccttggagagatgctgccctaatttaacgaataggcacgtgtcctttatttggcaaatcagtacactgactggctcaggaatgtgcatgtgacctaagctaagccaatgagagttttccctgggacttttgatggaactatcagaacagggcagtcatgagagaacaacttatcagaaaataaatactggctaagaaattgagagaagaaagcaataaagtggggatggcattgcttgagttcttataataacagtaaaaattgacattcactaggcacttattatgtatcaggcaccattcttagtgctattttaattctaataaactccctatacggaagaggaagttagggaaatacttttttatctctattatgaatttttttggtacttaaaagcagttctcaattcaacaaaataggttgtgtgggaggagaaaaaaaatctttacctttaaaataaactgaattttggtgataagcctttgagtgttttcagaaatatactgaagttgtgacgacaaaaataataataataataattgaccgctgatggagaaaagtgattttgctaaaagaaatataaaaagggtagattaactttgtaatgatgtttaattcctattaataaaatttaaatacagtgcttttaggaaactaattgctcttcagctcctagaaagattttttttaaagggcagtgattacttatcaaaatgttcagccaatatgttcttagagcagagataatttcatctccagaaattgtatgtctcaagttaatatacacctcttatgtccggataaattcagagggatgttgccaaggctgcaaaaggctggaagaaattaggttaatagatgtgcgtggctctttcaaagagatctgagtgttttatcttatttgatctatttatgaaatgcttacaagagacaattaaaataacctcatcacaggtctcctggtctctgaagccacctcctaaaaaacaaatatctaaacaccaaaattatagatctactccatgctcaagtccctccatgtctcatgctgcctacaaaatcaaatccagactgctctgtatagtaaaagctcttctataatacaggcccaatcaacctcactattctctttttctcactttctctctctcattctcacacacatcgtcacactaacacacacacacatctgcctttgcacacacacttatacctacacatattcacaattaaacatggaaaaattcataatagagataaaaagtatttcccaaacttcctcttgtgtataggaagtttattacaattaaaatagcactaaaaaccgtgcatacataagtgtctgatacataagtgtccagtgaatgtcagtttttactattataagaactcaagcaataccatcagtacacctacacatatatgtatacatattcctatacatctatacatgaacctctacataaaagcacacttatatacaggtacattcatgcctacccacgctcacattataatcacatacgctcacacccacacgtacaactacaaatacacacatacctaacacaaacacatatactcgaacctctacacacacacacacacacacacacacacacacacagagaggatatgaagctacaatgatgcatacacttttcacaaaacacaccctgaacgacacccactttcctgcctatgcctacactatttcttctgcctggaattcttctccttattatctccccctactgaaatcctacccactcttttcaggcctagctcaaatgccaatactcccatggaacctaattctccatctggaattcatttttgcattttctttgcctttagaacacactttcccctcacttgtttattcatgagcccacatgccttcagtgctttccactgtgccgggtaatactggaagccctggggctacggtggtgaacagtcctcagagaggtctatcctatccctagagtttccagtctcggtggagagaagtcaaagcttaatagcaatgaagtgaatgaagtgagacaaatgctatgccgggagcaggcacaggatgctgttgaagaacacagcttcctaatctggaagagaatccaaaaaatgcttctaacaggaagtggcttccaaatatgaaacaggcatggtggctcgcgcctgtaatcccagcacttcgggaagctgaggtgggcagatccctcgagatcaggagttccagatcagcctggccaacatggtgaaaccccatctgtactaaaaatacaaaaattagccaggcatgggtctgtaatcccagctactcgggaagttgaggcatgagaatcacttgaacccaggaggcggaggttgcagtgagctgagattgcaccactgcactccagcctgggtgacagagcaagagtctctcaaaaaaaaaaaaaaaaaaaaaaaaagaaagaccaagggagttagtaggttgcctgttatggggttttatctttatcctatgggcaagtgacatatgtaagggatggggatgaggacttactgaagaccttactgaaatcaatcccccaattagaagtggattaaacacttcttctcaatgtagtgcagagatagagtttgtagctagaagattcggaaggcagagtgacaagctgggagatggctgcaggatctggatgacacaggccatgatggtcaggctggtgtgaactcaaagtgtaaaatcaacagaaaagagatgggctgtaggggtggggaatgagggcccagtttgcctcgaattatggttttgtagagtgtcatggctggccagtcttcctcaaccacgtgatccatgttcgatatagtatagtgctcacccacaatgcagttcaagaagtatccgctgaactgaattcaattctgactgtagcatatcatccatttttacttacaattcagagtttaaaaagggaagttgcctgtttactcatcttctctccttggagacaagacaatagaaattgcaaaactaaaaatcagacaggaaatttattaaaaccaacaacagaagcagagttcaggctgcctgtgctctagtctggctggacccagttagctcattgggtggtttcataaccatggggaaacaggctttaaaacaaacacattgagcttgcaaaccttcggagtatgtttcactccagaaaataagcagtgatttactcccaagctggagaaaacatgagtaattaactcttcaggaagatgatgttaaggaggaaaaacaaagcaaacgggagaccaatttctctccacctgaaatataaagtctgccaaaggacatgagataaatggccgtgaaggaaatttaaaatgatttagtgtccatatttatcataagtagcaacatggattagcatcacttccatgccgctgaatgcacatctgacacacaaacaaaccgatcacaggttaacacataagtaattctgggtcttgggttgctgcttgaaaccaaaagcagatctaaatgtaattgatccagaaacaacaataaagatatctgagccactgctgtggcttgatattaggttgacatatgctgtatctggaggactttgcagttgagttcagtgatgttttttaaaccaatacctgatctaaagagtatcccagaaaaccagtctgctgaaatcaagcgtcactttggaactcaattttcccctgtgtggtatgcacaaacaagtttctatgcagaaattactaaagagcaggtgtgggtcaaacctgctctgtcttcactgccatgagccttggatggctaccggcagagtgaaactaagaactgcttttcagatattgaggtaaagtgcctgcttcctctgaatgcactgttttaaatgcaacgattggaggtggtgggattatgaagctttggcatgaataagaacctttcctggaagctgattaagaatgcagactcctgtatctctggagtgttggaatcagtagatctgggataaggtgtgggatcctgacttttcaaccagcgtcctagagtcattctgctccgtgtggtctaaggaccccattttaaggagcaccaggaggggaagacctatgactaacatacaggattaaataaagcataagaacaagatggaaatctttcttcttgggttacttatgtaaccactggcaattgccagcagatctaaatgagtttaatcagctattagagccttaattaaattcctctcagttgaaatttcagaattgcctaattgttacacagctcacattggagaagtagattttttttcctctcgtaataactgctctcaagataatctagtatctttatggataacagcatcaactgtcttagaacccagtactgatctggtaattcatagaaacgtgttttgattgttatttccatgaacaacccgcatctctgcttccattctcctcttgaggctcagccaacaggggaagagctcaatgcttgttcaatctcaaatttaaaagcggaaaaatctttggaacaaagagccatcattttcttcaggagttcatgtataatcttcagtcctccagagttcctttgttgccagatccctggggaaagataggagtcctatttctttggattacttttaattctttgtgtgctcttaaaagtgatgggttcttgtaattagctaaaaagttaatagtgttttctctcttttggttctaccttggagtaatataatgccagagacttgaaaaatcagcaaaaataaaaaaggagctctttcataatcatggattaattttttgaacttgctcttgggagtccttcattgtgcaagttccgtatcagtccgtcttccatgggctgcaataataattattaaacaattaacgagtataattgttggcatttattgaggtactgtgatcaccccaacgggcattttctattttaccctcacaatcctctgataaaaacgccattattagactcgttttgtatgttggcaaacagggaatttaagtgacttgcccaagatcaaacagcaagtgagaagacctggaatctgagcttggacttcagggcaggagctgttaccactgcctgatatttccaaggctgccatcctatttgctttgggaaatattaaggcaaacatgagcagtttggtttcttaagggaatatttcatggatcagttgggaagacagtattaataattagcaccatgcagcacagtgatgtcctgagagttggagaagccaggttctcgccccaatatgcacagtcttccactttgggaaggggcaacattttctttccatgtggagcacaggaggtggggagaaagcagccagaggtggtcttacagtgtgcttttactcatgacagttttacttcttccatttgcctgtgaattgactcttctgaggaccttgaattccaccacagaaaatacctctaacagcagagctgcactgagctctactttgcaggcttgatgttgaattccactgctaccaacacggacatccaaaaggcgatcagaacagcagatcaggcagagaaaatcaactgttcaaatgtgaaccatgtgtcaattaggtaatttgggggtttcaaccaagaggaatgtcattaatgctctagcagctgattggacttctcccttgcctctgtggtcatctccatccattatgtaaggggccttagaaaggaggatttcatcttcattctgtatcatgttatatttgagatattgttggccaacacaacacaattctgtttctatatctgcatctgttattataaaaacccaaacataaacttggttgaacttaaggggctgcttcttggaggagaaaactagaatgcatataggtctgcaaaaaaagtttaggaggagatgtgaaggtaactaggacaatcacagaaacaggaattggggctggggaaggttaaacacataacattggatgagaacttgacctaaggacagtcctttgttacagtaacagtgataactattattattttttaatacctgcataaagacaatttagaaatatggtaaaggtttttgtttgaccttctaatgtactttttctgggtaaatttcaaagatcagcataacatccaattgtaaaataaatgaaatgccatttgcagtctggcagagtaaacagctcttttggggagtatttacctgaatgatattaagaagttttttttccctcagcaaacttgccaataagagttagaaagtggctaagagaggtagactgtgatcctgggctgacagctgaaaaagccttttatttattgtgataatcaattcattcttaccagcctgaaaattatgactgaacatgactatagatatgacttctcttactctatggcaagtttttttttaaatgaaaaccttgaaaagtggtaaaatgtggggctgagtgtgtaacagtttataaaaggagataagttccaggtaattaaactgcaggctaaggaagcacgagacttcaatgcatcaaacctgacttgaaggatctaacaagtcaaaagctgatggatttcctcactcagcattatgtaaaaagccaattccatttggatctcagccctgaacattcaaagttaacctcattgactgtgtctgcagagttttgcaataaggttacagaacctggaggtatcaatcagtggaacagcatttcatccccctcgcctgtgaaaagttattgcgttgtgagaggtgaaatgtctggaacttggtagcaggtctctgatgggcatttgttcttctgtatctggggcaaaataataaatttaagtttttgagatggacattttccttcttccaaatgaaaggggttggtgcctgaggccctgctagttattatgaggatgctaaccaaagccgttgtgcatgggtgaaatgcatcgttatgatgaaatgcacactgatgagaatttcaattttccttagataagatggtattttgacaatcatttttctttgctcatctctggcccaaaactactttgctccaggcttgtctgagctctaaagtattccaacaagaggatcatttgaaatactaaagccaacagaagatttaatagtgagaaaacagtaataagcttaacgacagctttgcccagttaaaaacgtgattattctaaggcactgggggaagaggagggttcccttgggatgggatggataagacttgctgtttttgaaaactaagcctaagtaacccaccaccgtcaatccaatttcacccaaaccaattatccccatctcagacagtaatcaacaatttgagagccctatggagccactgggagaaatgagaatcatggtgaccaatcaggaagcctctcagcattgcttttcccactgaattattaatatagtggcaaacacagcagtttaaaagaaccgtgcatttggagttggaagacccaagtccaagttcaactatgatacttatgagctatgtcacatcaaaacctttcaaactcacacaaattatagccaaaagcagaatctcaggattcctaattactccaagtgttacaaccaataaacagaactattctgtaggttttcagttccttagggttagatcacatgcattcatcttgctcattcattcatggagtgcctactatgtgccataaactgttctcacactggtaacacagcagtgaatagaccctaaacctggggtcagcataccacagcccaagggcaagctgtttctgcacagcccacaagctaagaatgggttttccttttccatttttaaatggttgaaaaaaatgaaaagaatatttggtgacacaattataaaattatataagatttgaatgtgagtgtccctaaataaagcttgattggaacacagccatgcttatttccttacatagcctcaacgcttgcctttgcactaaaaatgcagagttgagtgcttgccatagagagagtatggcccacaaagcctaaaatatttactagccagccctttacataaacagttaggggttttgtcaacccctgctctaagtccttatctgtaaaggatccactcaccagtgaggaagataaaatacaatgccctctgaattaatcatacaataaaacagaaaatgctaacagccaaagggtgaaaggtgcaagaaatgcagagggcttcagaagtgagaggcagatctgatgagggaaggaagaaatcatgaaggagtgcaatggaggggagttgtgcagtttgcaaaggacctgaaaagtcagagtggaaagaagggatgtgtaggatcagagaacagcatgcacaaaagcttagaagctgagttttaatgacatgtttgtgaactaggaagttgtccaaacaggaagaaacacaaatatataaaggagaagagagggaaagaggaataaagggataccatgggacaagactgaagaagcccttggatattgggctacaatccctttgtgcacattggaatttggttgcatttaagttgaaattggcaattggccttgggaaatccctctgactcaacacctggggataatattggtgatttcatccacatatggctaggacttagtactccttacatattttgaaattgtcctatttgcaagtaattgatgtcatttcataaacacatccatacttgtcagagcatttggataaaactgaaggccagtttttttgaccatctctccactgaccacctccagtccactgtagccacccattcctatgggtgaaattcacttagaactgcttgacttgagtgactctaaatttagaacctccagtccactgtagccacccattcccatgggggaaattcacttagaactgcttgactcaaatgactctgaattcagaaaatccacagctctcattcaggtattcttatgtctcctctccagcgtcatccctggtctctatcttctctcaattagtctatttgttcatgccttcatttcttcccgattccaacttagacctctttatccataacattaacagatttcttgtcatacccacaattttcctgcccccactttgtcttcctatcacacccacctggcagcaccctccccaactctgagtcaatcccaccacttccacacctgtaaagcagcaagtacaggtggagaatatcatataaccacatagattaatgtcatttcaaattttaggactccctctctggctaaaaatctttcctttttcctaattgcatctctcccattccctagaaactatttcaaaccttcacacctgcccacaagactgcaaagctgccagctccagccccactcccagctgatgaatctgcctcttatttcagactctatggacaacccacatcacccacaaactcacctgcctctgcacacatgtctttcttctcccctctttcagtaataaaggaggcatctctcctctagcctaacacgcatcccagcccttgggctctagatacattctcttctgcactgtccttgcctctcaaactgacctaagacctccagtggttttcactaaatccaacaggtgcactgcacataagcccctcctctgcatttgacaatgggactactcacatctttcttgagttctctgccctagactgtcaggacactaccattacccaactgtttcccacctcgttggctgattcatctctgccaaaatgcaagcttctccttctctgaacacatctgacttgtctttcctctccctcttgcccccagaacatccaggctcaggcctcggcctcttctgctccacagtctccagttatcacctctcttgacagcccctgatctgctgcctttcccccattcttctctactgcctccgagaaacctcaaactcagtaggcttagagaagaactcagcctcttatcttccaccgtaaaaaatagtttctctcccatctgccatataggagttcttgaaatcccaaccatggaaatatccattaattcatctctcttctgccacccccatatatattaaatcaatcaccaagccttgatagttctaatatttgaacattttttactgctttcctaactcacagccaccaccctcatccaggccttcacctctcactggtttatgactcagcttcttagctggccttcttgcttctggtagatttgctcttcatcccattctccaaacagcagcccaaaccatcactttattttttatttttttgagacagggtcttattctgtctcccacgctggatgcagtggcactatctcagttcactgcaacctccgcctcccgggttcgagcgattcttatgcctcagcctcccaagtagctgggattacaagtgcgcactaccacacctgggtaatttttgtatttttagtagagatggggttttgccatgttagccacactggcctcaaactcctgacctcaggtgatctgcctgcctcaacctcccaaagtggtgggattacaggcatgagccaccgtgcctagcccaaatcgtcactttaaatacctctgtgtatctggcccttccactccccagcttgtggccttttaatggttccccactgcagctggaatcaagtgaaaatgcctgaccatggtctaagtgacctggcctcctccccaggccttcccttccctctgcattcatgacagcctcattttgacaaccaactcctggttccagccctgccccacatcaactcatgaatcacacagaactaatcacaggcttctgagtacattgagcttttctctcagtgccaggtttcaacacgctactcaccctgcccagaaaaccccttcccactctctgcctggcactctcctatgtgtccttcagaactcaacacagagggcagctgttctgggaagcagcctctaatcccataaaactgggcaggtagcctctcctttccctacctcactagctagtgtgagacctgcacactcatctgtctgccccagtggactcattgagggtgggactgtgttctgtttgcctttatggccctcgtacccagcccagggctgcttacataatagatgcacaaatacctatgaaatgaacaagttagccaggagcggtggctcacatctgcaatctcagcactttgaaggcaaggcaggaggatcacttgaggccaggagtttgagaccagcccgggcaacatggcaaaactctgtctctactaaaaatacaaaaattagctgagtgtggtggtacatgcctgtaatctcagctactcgggaggctgaggcatgagaatcactttaacccgagaggaagaggttgcaatgagcctaaatcacaccaatgcactccagcctgggcaacagagcaagactctgtctctaaataaataaaacagacaagttagcacacagaggtaccaacatgaccaccataactatgatcttcctgcagtcaattatcaactataattatctcttctggtaataggccctgaaaatgatgtggattttggagtcagccacatctggacctgaattcccagctcttctgcttaccagctatatgaacttgactaactttacttcttggacatcagtttccttatatgtaatgtgggcataataggagtaatcacatcatattattctcatggaaataaataaagtagtaactgcaaggcacttattgaactatctgccacatagtccctgctcaaccaggattaggtgttttattatatacagggatcttagaaggatgacattaactcatgtttgtgaaccagcagtcagatgtctggcccacagaaggtatttagtcaaggttccttcccacctgcaatgtgcatgttcttgtaagctgaatggaggacactggcacaactccagaacaggcaggaacaaggcattgtttttaccaaaattccaggcctagggcttgtatgccaaaatgaaactaaggaaatgtatttggattttttttccctgctctaagaggagacagatctgcttttcacttacggctctctattttggatagaaaaaatatcatctgttaatataattctgtgcacggagaaggcggtcctgccaaaagccacttggtgttattttcactctaccaataaatccaaaggcctggcaattatttttaattccatttgctagtttgaggttctgcacgattaatgcatgccattaatttcataactataaatgtaacccaagctttcttggatccttgtgtcaaacagtgtgaccttatgcatacacttgctagtgttcacttggctaagaagctgtattggggaaaaaatgaaaagaaatagaaaaaaaaagatagaaatttcagataatagacacactggaagacacatcctagccagaaagctgcgtgtcattatgtggataataatacaaaagtcctagagttaatatagctctttatgggctagaagttgctggttattttctcatttcacttgaccatcacagcagagtcacatagatgtgaaagagatattattacaatttttcagagcggtaaactgatgttccttcaagtaactttttttcttttttttttttttttctttttttgtagagatggagtctcgctctgttgcccaaggtggagtgcagtggcatgatcttggctcaccgcaacctccgcttcccaggttcaagcaattctcctgcctcagcctcctgagtagctgaaactacaggcacacactgccatgcctggctaattttttgtattttagtagagacagggtttcactgtgttgcccaggttggtctcgaactcctgagctcaggcaattcaccctcctcggcctccctaagtgctaggattataggcatgagccaccacgcctggctcaagtaactttcaaatttaaggactattctcatgtctcttttccaatgtcattttggcctctgggctctggacccctctattttctcccaatcaatctgctcattcgtgactttccattttttccctattacagcccagatctctttatcacagcaacagatttcctgccacgcccacaattttcctgctcccatcttgtcctcctgtcacacccacctggcaccaccttccacccagctctgagtcaatccaccacttcctcacctgtcaaccaccaagcctcattcacaaattacagcaaatatgtgaaagaaccagaaacagttttctggctcctggatgaggacttgcttaactgtatgtattgcaatatattcatacatatgcaggacttaaaggactccttgaagacacttgtctctaaaactttggacccaggtcctttgataaaagagaacactgtcaatagacttttagaaatccactgaaaatgaaaaaaaaaaaaaaaggtaaaacaaccctaaaagtgccatttaaaagtctagaagtctagagtctagattgcactttgtatatgcataatagttcctgtttattaagatctttctaactacgttccaggcctcatgctagatacttggcatgtatatcatttatgatgcctctgagctatgaagtggctgggtgaccatgttccaatcaattcacttctctggtcctcatttttctcatctataaaataatatgtaccatttggggttgtagtgaacataaaatgtggtaatgtacataaagtggttggctcaggacctgtgatggaatcacagtttaaaaactattaggcactttttttttggaatgatgcaaggaaaactaagctccattcgcttcccacttaaattctctatctcccacagcatggcacaattgcacttgctttgtagaatttgattgaagaaagtagcagaagttagtagtcaaagcatgggcttcggagtcagacaaatggggttcagaatacggttcaggttagcggaaattaacttgttctctgttccttagacttctcatttataaaataggggcaataatagtgccaatatcatcaggattttgtatgagttaagagagatcatgcatctaaagttctgactcacaaaaagcatttaataaatagtagctttaatatcctcacaggaaccccaaggggtgggtattatcattagctccattttgctgttggaaacaaagaatgacagatttccagaattagcgggagtctcacaaatgttacccctggccaaactcaacagcgtaaatgttgatcaaactcgctctctaaccccaaacagctcagctcctaaccggtgccatgctcagtgaaacaggggaggaagtcgccagcccacttttcctgaccatgatgctgttctctctttgtctacgtagactagtcacttcatctcttggcattgattttgtattttgggcttctgatcagacacatctgtgtttctagcttttgtccccactgatttatagtataacttgacagatgtcccatctgtattttttgaatcctcatccattttcagtgagatgacaatgcctcaatgcaaagcctccatgtcattttggtaatgaaactcaaatcttcgggtaaagaaaatgtggtatatatacacaatgaaatactatttagccataaaaaagaatccaatcacgtcttttgcagcaacatggatggaactggaggccatgatcataagtgaagcaactcagacacagagagacaaatactaggacagatgtggtggctcacgcttttaatcccagcacttagagaggccaagtggaggggtgggggaatcacctgagctcaggagtttgagactagcctgagtaacatggcgaaaccctatctctacaaaaacaaaacaaaataaaaacaaaaaaactagccaggcatggtggcacttgcctatagttccagctacttgtggggctgaggtgggaagatcacttgagcccaagagttcgaggctgcaatgagccatgattgcaccactattctccagcctgggcaacaaagcaagaccctgtgtcaggtgttagaaaaaagaaagaatgaaagaaaaagaaataaggacaaatactgcatgttctcacttgtaagtgggagctaaataatgcatacagttagatgcagaatgtgtaatgatagacaatggagactcagaaaggcaagtgggtgtgagggaggaggctgagggaagaggctgaagagaagctacttaatggatacaatgtatgttatttgtgagagggatactcaaaaagccctgacatcaccactatacaatctatgcatgtaacaaaattacacttgtataccccatacatttaaacaaacaaaaaaagaaacccaaatcttgctgtattgattcaagtcaccaacctgaatgccaaaagtggaatgagactgggtgcagtggctcatgcctgtaatcccagcactttgggaggctgaggcaggagaatcccttgagctcaggagtttgagaccagcctgagaaacaaagtgagacaccccccatctctaaaaaacaacaacaacaacaacaacaaacaaacaaacagaaaagaaacatctgtggaatctttcctggtcttagagaaaacaaaacaaaaaagtggagtgaaatgtttactattcttgcagaagaaggctgaacaagtctcgtctctaaatcttagtctcttcacctattaaaagcaggtaaatgtttctgctttccctgtatacagcatggatgtcaggatctgatacccaaaactaattgttgccctgctttcctatgttagatctgcctgtcctagtttcttcaaacacactttaattgtggaaagaaaacatatgccatcagctataatctgctggaccacatagaggccagcacggtaggaatcaacaggaattaggattcttccgattcaaattgtttgtttcaatgttaaagttaaagacaacgtaagtgagaggccattggtttctatgagtcattctacaactccctttaagggaatacgagttgattctcttgtttttccccaactttagatttttttctcatgggcatttccaacggagtctttcttcacatccagggaagtcaagatggctcagcctctactcttcccatctcaaacaggcccactcagtctttctaatttgcagaattataatttaaatggaaggaatatagactccaggaatatgatttcgatgagttttaaagcacgttttcaaaagacaatggctagataacaaaccatacggtggagtaataaggaataaaggaacagtttactgcaggggtggggactgatttacagcttcagatgtgcagaggaatgctgattcgttttgcacaaaaatgcaagagactgattaggaggcagatttgcatacatctcagtgggatgctctgagccgagctcagaaacagacatgtggttcagcagggaatcttgtacctgtaatagtccttcttgccaacgctgggggcacatccactgtgcagggatggggggacccccaacatgagtttttataattaaagcactgacagccttcactactgatatatgaacgccacccatctctaccataaggtactgtagaaacaaaatggactttgcagtctagcagacctgagctagaatctagactttgccatatacttgctttgtaaccttaggcaaatcagcaatcatcttagagcctcagtttcttcatatgtaactggagggagggggcaggagtgatcatactcatcttgaatgtctgttaaaagaggatcaaggctgggcacggtagctcatgcctgtaatcccagcacttcaggaggccaaggcaggcagattgcctgggctcaggaatttgagaccagcctgggcaatctagcaaaaccctgtctctacaaaacatacaaaaaaattaggcaggtgtggtggcacacacctgtagtcccagctacttgaggggcagaggctggataattgctcaagcccaggaggtagaggcctgcagtgagccactccagggagtgcagcggcatgaacatggctcgctgtggccttgacctatgggctcaagcaattatcttgcctcagtccccacaagtagctgggactacaggtggctcctcactgcagcctctcgtctcttaaaaaagggtgtgtgggggaatcaaagtggtgaatctatagcccctaggccataatcatcatcatattttttttataacatatgggtaattatctcaaggtacaagttcttcagagtctagaaagcacattaaatcctccacagcttagagaccaatgctgagaatatgcaacctctttttatctctatttctccccctgttccaaaccaggttccaatgccaagaaaaacagggtagtggaatgggaagcttctgctgccaatggcacagatgaggaaaccaaactgtagctacagaggcaggctgacagagccacttgtagccagaagcagattgctggggggagcagctctctgttctgtccattttcttagggacagatgttattcctgtctgttccatcagcaggcaaatggggaaataatagaacagagacaatggaaagaaagtgagaagcaggcccagacagcagccactgagctccagtaattgtgggtggggtaggggagaaatctagctgctgctatcagatgcaatgtgaaataaagaaaaataatgtttgtggttcagttactagaatggataagatgactgtcaccctttggatagctcttctttatcctttaggacttggtcctaacttaggtctttcaggaagttttttcacctccccagtgcccaggctggagtaggtgtcccagtgtgccatgtgcacctctcctgtttatgctcatttcacaatgctgtaactagcagtgcatttccctgtccctcccactacattataagttccctgttggtagaagagctgaggcaggactagcttctctgtcataatgtaaaagagtcttggaacgtgtcctgggcccaggctctaaaccccctcatggcctttggaacaccaagctctgtgccaaagggtggaaggctgccctgccacaccacaatctaagcccagggcataaaacccctcgtggcttggatacaatccaaggctcagggcataaaatcccttgtggaattgcactggaatggcctctggaatgtgcacagacttgctggctccttgcttcttactctcccaggcttgtaaatatgttctccattatctcaggtagcagagcatattacatatgtgtcaaagaaaatgctaaaccatcacagctatgcttgatgcactgctacctttctacccctacgtcctcatgtcctcacctgtttacccccacatccgcacgtcctcaccacctgcttctttgtttgatcaccaataaatagtgtgggcttccggagctcagggcctttgcagcctccatacactagcgttggcctcctggacccaccttatatactcttaacctgtcttttcccattcctttgactctgccggattttgtagcccccacagcctggtgttgggtctgatcaccccaacattccctaaaatcccggggatattttattagtcatctctgcttcgcctgtacctactacaggcctggcactgagtcagtaatcagtgaatgcttggtaaacagatcaatagtgggtaagtgggtgggttcaagagtgaatggatgcccatatggctggatgaattacggttggtctgatgggctgatgaatggatggatggtttattagatgattaatctttggatgactagctgggtgcatgggtggataaatggatgggaaaatggttcaatcccatcagagacagtcatagtgtatagttactttgtcctaaagaatacgagttaagtccacacaaaagcctaggtattgtcatacccccaacttccactcaacttccaaggcagataccatccctgtgaatctccacaacctatatgaaaatttccatcattcatcctaggaactgtgcaaagtactggaacaagcactaaacttggagactcacaagacctaaatttgaatcctttctcagctattaattttttaaaaatcatagaacatctctaagtttgcatgactcaaatatgaaatcagagactcacttcacagggttattatgcggctaaagtgaaataataagtacagaaggccatactgtaaggtttggtatagaataggtgctcaacaaatgcttactatttatttacgtcatattcagacaactactacagtcaatctccttcctctacttgctttcaaacttattttagaaatattttatttttccccaaatggaagctcactttgaacctcaacataacataccaatcagatgaagctttgccatctccagttgaaggtgggtcttacctcataagccccctacccacccagagaccctggtggcactctaagttctgaaaggaatcagcattcaagggaatataattagaaaagaaaatttgccttaaagtccactgttactttgttctctctctctcgtctcctcttcccccttctctctcccccttcctctccccagttccgtcttcctctctccctctcccccctctctctccccttcttcccctctctcttccccctcttcaggccctctctatctcttccactccctctcccacctctctgcctctccctctcttctccctctctcctcttttctccccctcccgctctcactctcccccttactctttccctctccccccatcccccctccctgtcctgctatccctccctagccctctccctgcctccctctcccccaactctctctctcctgctttccccgcttcctcagggctttgcgtttctctacaacacagatgagcagatgaccctgtcagaaaaccaaaatggttttcattggtctattcaggagtttctagaaatacttctgactgagaggctctttgaataatttactcatctgagatcatttaaataatctatttgctcattttcataattgatggcaatggaaaactagcaagggtgcagcttttgtcttacatttataccacctgtcagcttaatcatgctcccatcaccctcagagagatccttaacaatttgggtttgcgactgggatggagaagaatgttccatatgaccgaatgtttgactctggctctattaaaatactgcttgggctcaagtcctgcctttaccactgtatggccttggacaagtcattcaacccatgttgcttccaatttctctcctataacatgaggatagaaataattatacttagaactggcatctatgtgtcagtgttctaagcacctgatatatcaccttgtttaattatcctaacaacctaggaggtcagtactattatggcctcccttttagatatgagaaaatgcagagaatgttgggagactgaaacaagattatccattgaaaacactctgcatggtgtctgacacacagtgggaactcaactaatggtagctgctgccctcatgatcatcccatccatcaagaacatcaccgtcatcaccatcatcatcaatcatctttatcattagtatccctatcaacgtatgttcccatagagatgtcttttctatgaactgcatttttttttgttttaagttctgaaatctgaaaaactttcagcagaatgttgctctgcaggagagcgcctgttcaactgctgttctttttggagttgggttgatgttacaactgcaacaacaacaacaacaacagcaacaacaaaagaaccagtgcaagacacacacacacacacacacacacgcacacacagttgcacacacacatgctttgggagatggcatcacttatttcagttgaatgtgttaatttgctagagatctactatattttcctcactgtgacctaacatattgtactgtgtgagtatttaaaatagtcactatgcgtgactctagggaagtcagatgattattttattttatttatattcacctttgctaaatcctgatgcacagatgataattttaaatgttttataatggctcaattttccctctctatggctcacatcatttgagaaacttaacgatcattatataaggaaacaaattaaattccacacagactctgctaaggttgatattaccaaacccattttataaaaaggaacttgactttaaatatggatttgggagaagaaagaaaagaagagaagaaaggaaggaggatgacagggaaggatgagagatgaacaatgtcatttacaggcatggcaaagctcttccagaaatacctaatctgaaaatacctaattagagacttacacctaaaaaaaaatttttttaatctatctaattcccctctgtcatgcatctgccagagaatcagtgcagccaatgccatggctttcagttctgtttctgaaatttctctcagattccgcggccactattcctccccatacctctcttccctctaacccaagccacgtaaataggcccttaaaaaatttcccagattcttgacaatcaccattttccttttaaagaagcagtgtagctcatgtctaagagtgcagacaattgggttccaaatcctggctttgaaatttactagctctgtgactctgagcaagttattgaatttctctgagcctcattccctccatttgcaaaagagggtaatagttgtatctgtattacagtcctgatatgaggattaaatgtatgcttaaaacctaataaatgttaaacaaatgtgagtgatgattattttttatgttgttctctcatctcaagctcttcaatagtgccctgaagattactgaattaagtgccataacctatcatttaaattctagcatagtcctttacccccataaagtttccttcaaaagatttgtactagtctgttgttgtgtagcaaattacctcaaacttacccatttgaaacaacacctgtttatgatctcacagttctgcaggtcagaagtcccagcgggctcagctgggtttttgctcagggtgtcacaaggccaaaatcatggcactacccaggctgggctcatatctggaggatcttggaagaatccacttccaagctcactcagattgttgggcaagctcacctccttggggttatatgtctgaggtcagctagggactgacagtgcctagaggcccctgcattccttatcatggagccccctcgatcctcaaatgtagaagtcagactaagcattctcacactccaaatttctttctgcaactattaggcttgtgtgaaactaattgcagttttcgctgttttttttaaatggcaaaacccacgattacttttgccccaacctaatagctgcacaaaactttctacttttaaaggggtcatgtgattgggtgaggctcgccccaataatctccttgttgagtaattcaaagtcaactgagaagtcctttctgccatgtggcctaataaaaccaaggagtgacagctcatcatgtcacatactcccaggggagaggcttagaaaaggccaagtgtcactggagaccattctaagaattctgcataccacacagctatgttccaatcacattgaactcttctccagatgggccttgggcactcttgcctctgaacctgactttttcccactgcatggaatggcctcctcacacatattcagaaatccaaatcttgcttattctcgtgagaccttgttcaaacgagaaatcctccatacaaacgcccttgattcttctgcctccctataacatctctcttctctaaacacctggagttgccaaaacatctttatggcacctcacatgctctcctgcagttacgagcatctcttagtgccccgttagactctaagtctcttgaaaaccagatgtcttatctgccttgcaaccctcagatatgacttgcacatagtgagtgctcaggaaattttctttgacaaataagtgtgtgaataaatatggattacataataccctaagttctattatctctgttgatgggacaaatttttaacaaaaaaatcatttaataacaatatctattgagaaaaatctaggtaacaggcactgaactacatctataaacagcgttttatttgccttgttattctctcatttgccagaagttattcaagatgcaacaagattccaatttccttctttccttttcctctgtagtttctcctaagcattgctactgagcagtatattccaaaggaagaaagaagcacaaaagctaagaagcaagaatcttgataacaggatgacctaaataaaaccatttcagggttacacagagtaagtctatgccctaaagcagtagctttacatctttaatgggcatgagaatcactagggaggcttataaaacatgcagattcagaatcagaaatgctgattccatagacttgaggcagggctaaggcctttacatctttcccaaggtgattctaatctaggtagcccaaggaactacacgtataaaaagcccatactaaaagatgctcctcatttggggaagttaatggggaaaagagtctttccattcattctccaaatccttattgagcctctgctattgaataccagagatataatggtaaaggagagactgaaaacacaccatgagctctcagtgctagccgtggccagaattcatggctttaccaatgggctgctattgtctttctaagcaaagagagttgtaatatgtttctccctgccggtagaatgtgtcacaatgttcttcaattttagcaatccacataatcgttctatcaattgtcatttactggtgtcctcacaattgcaatttttctccatgatttcttttacacaatcttcactgggatgtgtgcggagaagccaagaacaatgtttgcataaatacttccatcctctggctggatgaacttttttgaagactactgatatctcatacacacacacaacacacacacacacacacaaacacacacagaagcaaactgacactaacaacctgcatgttttcttgagatcttgaaactcactgggccctgctaggctaaatgtggtagtagtgatgggaaagagatggcaaggagagggagctaaaatacaataatttagataggagggagctatagcattctataattacaaatcacatcatgtaataattgcaccccacgcatcactatgcctcactagacctgatagcacaatgatacaccacagtcagaaccacagactcaagagagcaatcatagcttttgtaagatctcctttatcatatctgtactaggaatcctataactggaatctactttatttcacacaagacataacatatggggtgcatcccctcccttaatgagacaaattggaagatgaaactactgtagaccaaaaaatagaaggggccgggtgcggtgcctcatgcctgtaattccagcactctgggaggtcaagatgggaggactgtttgaggttaggagattgagaccagcctgggcagcatatcgagaacttgtgtctgcaaaagaaataaaaattagccaggcaaggtggtgtgcacttgtgtccccagctacttgggaggttgaggcaggaagaccccttaagcccaggaatttgaggctgtagtgggatatgattgtgcctgcactccagcctggtaacagagtgagaccatgtctctaaaaaaaagttaaaaattacaaggtctgggagatgcaataaatgcctataccctgagttctaattagctggtttcaggtagaatcaattgcatccagtgagaggaaaggaagcagacacctttctaagggtaggaggaggaactccctaaatttctcctctagaatacctccttcccgctgccagttgttccacatgatgtagtggtggtgaacacagccttcgggggcaggcggacctccacttacatccttcttccatcacacaccagctgggagatcttaagctggtcactaaccagagagaaactctggttctctgaaccagaacttccatctctgaagcagggagaagaatacctactttagaagtgctattaaacaaatacctactcagatgactaaatgagataatgaatgtaaaattgtcatcatagttattggtacagagtagctcttaataaatggcagctgaagtcgtcgataccaacagatcatagaggggtccatttgtgcactaggcccaaacccttgtggtgaagctgaaaaaacacagatgaaaggaacagaccttcccctcttggggattctagtctaagcgaagatgaataggcaagcaaacaatgccaaagcaagctgttaacactcttacgaattagtatacaggtctgcaggaatgaagtggaaaagggcagacccactttgagctacccagatatagaatcaatggaaagggtgtccttagcaaagaggacaaatgtttgaaggggcaggaacatcaggagcaggtgacagctgaatactagggcttgggggacactccggggataagaagaaagctttctgtgttggggtacgggcgaataaacatatccgtgggaggaagatgatgagtttgactttggacaaggtgatattgggtgtctgtgggtcagccacgtgtggtgctgtaggcaagtctggaggccgtgagacagatctgggctggagggagagatctggttgtatttctgtgcaaaatgcacctgaaaccaaatgtaaacagagtggtgaaaacaaaaagaaaaacagacccatcagagcgagaatgggacatttccttcaggaagacacaaggaagggtctccctaatgtcttctggaacatcggtatcatctttaattggatcttctctggggaataaaaggcttgttttactttaatatttatgtgttttgtcctatttacatttaaagtcaaaacttcaaaaatctttatttatctctctctttctcaatatatatcccttttaaagtttgtctaggatacactaattagttcagtttagcttttccacagtgtacaaatatatcaaaacgtcatgtgcactaaaaatatctacaatttttatttgttaacttaaacaaatttttaaaagctagcctgtatgtgtatataggtgtatgcataaacacacatatattttcattttaaagctattgtaaggccaggcgcagtggctcatgcctgtaatcccagcacattgggaagctgaagccggtggatcacctgaggtcaggggttcaagaccagcctggccaacatggtgaaacttcatctctactaaaaacacaaaagttagccaggagtggctgcacgtgtctgtaatgccagctattcgggaggctgagacaggagaattgcttgaacctgggaggcagaggttgcagtgagcccagatcgtgccactgtactccagcctgggtgacagtgtgagattctgtcttgaaataaataaataaataataaaataaacaaagctactataaccctaaaatggtaaccagaattattctcaaagcattttttttcaggtagaataagtagttcagcctagagcaatccaatttattactcaaggctcaactccaatacctctagctttacaaagaatttctctaagtgagaaattctcacttagagaatttctttttttttttttttttgagatggagtctcactctgtggcccaggctggagtgcagtggtgtgatctgggttcactgcaagctccgcctcctgggttcacgccattctcctgcctcagccttcagagtagctgggactacaggcacctaattttttttttgtatttttagtagagacggggtttcatcatgttagccaggatggtctccatctcctgacctcgtgatccacccacctcggcctcccaaagtgctgggattacaggtgtgagccaccgtgcccggctagagaatttcttgactggcccaagttcacccttctctccgcctatgtagcacttatagccatttgttccagggttggcttaattctctattatgagctacttgagaagacacatagtttcctacacatccttgtagcatccctggtacctaatgaactgctggccacagagctggcatacacgtggcattggttgtactagcctagactgctaattggcaggaagaccccttacacctaggaatttgaggctgtagggtcttctgaggctgaggttgaggcatctagggttttgtttttgagcatctctgggaagccttggactcatcaaactctaaggcagaccaaaatcactgaagaacaagggagagagaaaaggcatggaagtcccgatttgtgagagaaagtctgctccattctgagttctgtgtctgcagtatacaggcaggcctggtgtttggcgtctgtataatccacaccagccacctacaaaggcctggaaaaaagcaagtgcccctctaagggcttgtcgtgttttcccagacaccctcattacatgctgctgctttcagtgacgccactggctgacctcggagatgaaaagaaatcgcctccgagtcccagaataacagctccctcctcagcagtctttcccctctgctgacctgctgtaccagcgtgtagtgctgggggggcagctttaagggtaacacgactggtatttacctgctccactggctttctctttcttagagacagaagcacacggagttatttctgaagcactagatcccctgagtgccaagaggatagagcaactacaggcagtatttgtgcattctaagctcaactcagcagcaattcccaaagctgccttttatgggaaattgctatgtttcaacaggaatttgaagaaaggcccacaaaatattaaaaggcatcttctgtatctggaaatggagtgtatcaagggcagctgtcacctgcactgcagtggcctccttgtgtaccagctccctggaagatgagtcagattctaaggtagcacagaaaattcacaggtgtgagtcaagcctgctccaggactggttaaaaccaaccaaagggaatgatttggtggctccaaaagtgaatcgcagattgtgtaacatcaaaaggttgaaaaccccaaaatgcaacaacataaggcagaaaggctccaactctctacctcctatggatgattagaaaaaaaacatgaattgcattttggctttacatgtgtaagaggaaaaaaaatcaggatttgaaagatggataagagaaagtaatgatataagaaaatattataggcaacaacaacaacaaaagcatattcaaagtcccaaatgcatgaaggaacccagtatatacattcatggagttgcaaatcacttgcatggtgggctacagggtgtataagagggaagaaaggaggttaaaaccaaggacagttaactagatgctaacactttccttaagcatgacagaagcccatagaatcccagccgactccatctccatatacacactaagatctaagtttcttgagtacagaaaatattttttctcttgtttatgatggactccaagcatcaaggatagggcctggtacacagtaggcacttaataactatttgttgaataaaaaaatgaatagacgaaccatgaagtcagggctccggtggatcaactgaaggatcaatacaagaggtgatcaataagcaatggatattgttattataattggtattcatgtcagggggttaaatatgaaagctcagtgaaaactgttagttaattgtgctgggtatcccgatctgaaggatttaaggttttgttgttttgttttgagacaaaaccttgctctgtcacccaggttgaagtgcagtggtgcgatctcagctcactgcaaccctcgcctcccaggttcaagtgattctcctgcctcagcctcctgagtagctgggattacaggcaccaccaccatgccgggctaattttttgtatttcagtagagacgagatttcatcatgttgcccaggttggtcttgaactcctgagctcaggcaatctgactgccttggcctcccaaagtgctaggattacaggcatgagccaccaagcccggcccggatttaggtttttttttaaactaagcacaatgacatacaacaaaatgaatggatcttgtgtcataatttgatgccttttgacaaatgttcaagataggaaataactgccatcactccagaaaattccctgtgcccctgtcctgtcaactgcactcacccacagaagcaaccactattctgatatctaaccccatagggaacgtttgcctcccttgaactttatgtaaatggaatcacacaatataatctttcatgtcttcacgtaatataatctttcgtgtctttctttgattccatataatgtttttcaattcatccatgttgttgtacatattactaggccattctgttttattaatataccataatttgttcattcatttccttgttgatggacattgaattatttctgatgttttgctataatgaataaagttgcaatgaacattcttgtacaagtattactttttggatatatgtttatctttctttgggataaataactaggagtaaaattgctggataagatttgtgtgtgtatgtgtacgtttattaaaaaacaaacaaaaaaaacacacacacagtttttggccaggcgcgtggctcacgcctgtgatctcagcactttgggaggctgaggcgggtggatcacttgaggtcaagagtctgagaccagcctggccaacatggtgcaactatctctaccaaaaatataaaaaattagcctctgtggtggcacatgcctgtaatcccagctactcaggggggctgaggtggagtctcgttctctcgcccaggctggagtgcagtagctcaatcttggctcaccggaacctccacctcccggattcaagtgattcttgtgcctcagcctcccaagcagctgggactacaggtgcacaccaccatgcccagctaatttttgtatttttagtagagacggggtttcaccatattggtcaggctggtctcgaactcctgacctcaggtggtccacctgccttggcctcccaaagtgttggaattacaagtgttagaaaataaaaaagagggctgggcacagtggctaacagtgtctttagatgagcaaaagtttttaattttgatgaagtacagtttatttactgcttaatggtttttcatatttggtttaagaaatctgaggctcacagatcacaaaaatattctcctacattttcttctagatagttttatctttcacatttaagcctgtaatctatttcaggtaattatgtgtgcatgcataatgtgagcaatgggtcaaggttttttttttccatgtagattgcctgtttatccaataccatttattaaaaagattttccttttccctgttgtcataatcattgatcaaaaatcatttgaatgtgcctatgtggatctattttcattatttcatcattaaataagatataagcttatttaatatatatattttatgcaccgtagtctaacttagaataagacagaaaaacttaaaaattgtcaaataaagcatctcatgatatgcgtatgtgcatataatatatataaatcgatatatatattataggtttttcatagataccctttatcagattgaggaatttaccatctttatcataactggatattgaattttgtcaaatgctttttccgcatctattgaaatgaccatatttccccctttactctgttaatgtggtaaattaatttaatttttaaatgttaaactaatcttgcattcctcagatagcccccacttatccatgatgtattatcctttttaaaatatattattacattatgattagtaacatattgaaaaactttgtatagagtgctgttatttcttttaaatgtttgttatagatagacgaagccatctaggccaggagtttctcttttgtctttttaaaatgggaaagtttttaggtatattttcagtttttcagcaaatatgagctattcagatcgtcaatacctacatctcagttgtagaaaattgtgtttcttcagaatttgcccattttatctatatcgttgaatttgttgtcataaatttttcataatattctttttatcttttaatgcctgtaggatctgtagtgtctgtaagtgatagtccctcttgcatttttaatattggcttatttgtgttttctttcttttgtgtgatcattattgctagcgactgtgaattttattagtcatttcaaagaactagcttttggctttgttgatttttttctatggcttgtgttccaccttgttgatttttacttgtgtatttatgatttttttcttctacttcatttgttcactttgctcttttctaacttctaaatttataagcttaaatcattgacactgaattcacactttccttttttattataagcagttaaagctatgaatttcttagtgtgccttcaatcttattcctcaaattttgatattttgtgttttcattatcattctgactaaagtattttctaatgtctttctgatttcttctttgacctataggtttagaagtgtgttgccatttccaaatatttggagattttctagatatatttttgttactaatttttattttaatgctgttatgatcaaagaatgcaccctccattatttcaattcttctaaacacattgagacttttgttttatgctccagaatgtagtctactttggtggatttcccatgtgcactcgaaaggctgtgcattttatagttgctgggtgtaggatgcaaaactttcctaagcttcctcctcactgttcttttctaggaatctgtcattgtctccccagagtcaatgcttctgtttgtatagtatttccccctgatttcagtcaattacattatgtctcccacagcacatcctatatcttccttccctctagggtcactcaggcctccatttgatgtactaagtgaagataaatttcaagatgctaaagtagttcagaggtcatgcattgcttgtcaaaaaacataacaaaaaaataagataacaacgtaacaacaaaggctttctgatcccttttattctactctttatacgaaattgtagcgactaacttaagcatttaattatggaggaggagggagggcaactgaaccagatattgtcattgtatgtatgagatcatctgtaaattccctgtgacatctctcctctctgacccaggtcatgacatgtatggtacataagatgatgatttttttctttgcaaacgattttttgtattttcaatagctaatatacatgtagttgaaaatatgctttataagaaaaataacctccctctctaactcatgatttacagaagtgatacatttaagtttttaaaattagtttatttaaagcaaaagactgagtacatgaaaatacagagggttcgttcatatggcaatgactatggtacacaattaggaagtttaggcaaacttctatgatcattgctacatagtcaacacttattagtgtaatgctgcaacccagacttcactgtctttaaattatccttagttcagacctttcctactgggatttgagaacagacatacagcgcaccacacaattaccacagttcacccagagaaagcattccaattgcaccttacagatttagtctgccttgttgcaagaaagacgtgctcttggctgtgagatgggatctagagcagctcaacaggaaatgcgtgggagaaagaagcactgtgagcccctttattgcccatgctttcttccctcccctgcattcagcacacagaaggatgctcaccttttcccattcccggtctttgttcagcacaatcaccaccagcctggggtgcacctggtagccttcctcagtgaaggataagtctttgccatcccatgtaacattgaccataaatctagaaaggggaagagagaaagacaaatttttaggaaagaattagagcaatcgaacaaataagtggatgccaccattaatggaatactgaaaaattataaacttacaatgctatattcatcacaagaagcctctctgcagaagtattaataaccatgcaaccattgctagttgaccatgctttagtaattgactgtaattaacacgtggaatgtaagctttttgtcctgccagattcatagacctatattcaaatgatcttcttacaggaagatctgaaaacacattctattatactctaacaaacttccctgaaggaagctgcttgctcataaaccacatggcattcaatgttgaaaaaatgacattccattattcattatttattcaactaatatatatgaagcatttgctatatgtcaggactcagctagttggttcagggtaaataagaaaatgaacataattcccaccctcaagaagtttagagtctaagggggaggatagtcatgaattgattaaacacagatttatgacaaatgatacaagggacgggagagtatgctataagaaagtgaaataggggtgaggcaaggctgaggaagtgcagcttgacctgaaggctcaattggcattaactaggcaagaaaagacacaaacaggcaaaagaggcaacatgtgcaaagactctgtggtgtgcataccaggaactgaatgcagaccagagaggctgaagcagagaaagacaggaaaatgtgagatcaggtgaggctgagaagatgaataggaacagaaagtgcaggattttagagaccatgttaaatgtctgtcttaaaaccgtgggaaggtgcaggcatggtggctcacacctgtaatcccagcactttgggaggctgaggtaggggaatcacctgaagtcaggagttcgagaccagcctgaccaacatggagaaaccccgtctctactaaaaatacaaaaaaattagctgggcatggtggtgcaaacctgtattcccagctactcagaaggctgaggcaggagaattgcttgaacccgggaagcagaagtcacggtgagccgagatcgtgccattgcactccagcctgggcaacaagtgtgaaaccctgtctcagaaaaacaaacaaacaaaaaaaactatgggaagacatagaagcgagggtgacatcaaagaggtaatagatcatgtcaattgaaggctgtgtagagaatagattggaggggaaccagagcgggtacagagggactacttatgctattcttacaaaccaggtcaaagataatggtggctttgactctggttgtggccaaagaagaagagaaggaggaagagaaaaagcaacagcaaacaagaccgagtggagagatatttaggaggtatttagtgaaagattagatgaggggaagggagaaagaggcatcaacgatgactcctagaatctaccttatataacatgtataaacttaatttttggtctaggtgttttcattgcaggtaacatctatctgccttacaacatttataccctcatcactcctcaaagccaccttggcctgtactcaggctgaactcagagagccaaggcagacttcatctcccagatttcgggtgagaggttccccaagggatccgctctccttgcagcttgagaaaaatgtgatgtcgttaaagacatctgagacaacatggtggtggccactcagcagacacaagatacatccaatatggtggattgaagcattcaaagacttccccagaaagatactgtgtcacttgcttcatattccattaacatccagagatgctaaaaagtgaaaaaaaaaaaaaaaaagaagaagaagaagaagagaactaggctacaagaaattttaagaagagacactggcctaatgggtcacatgtacatccctggaccagcatggtgcagaagcgactgatgggggtgttgtgtgggggagaatctggtttccaaggacaaagtgaagaaattggggaaaaggaaaagagcaaatattgtgtatttattcaacagaccattcgggtcattgaaaatcatgtttttgaagacaaattaatgatgcagagaaaatgcttactatttaatgttaaagaagcagaaaagaggataaaaacagggcttgtctatgtctaaaagggttatgggtatttttcatttttttgtgtgtgtatctttgtattcttcaagttctctgcaatcaaatactttaacaaacagaaaactaaaacactgctattctagaaggaacaaaggataatcactattctatctggtttatttggggtatctcttatcacttcctagaaaggttttttgttttttgtttttatttttgttattttttttaagacggagtctcactctgtagcccaggctgtagtgcattggcacaatcttggctcactgcaacctccgcctcccaggttcaaatgattctcctgcctcagccttccaagtagctagggttacaggtgcccaccactatgcccagctaatttttgtatttttagtagatacagggttttgccatgttgaccaggctggtcccgaactcctgacctcaggtgatccgcctgcctctggctcccaaagtgctgggattacaggcatgagccaccacacctgccggaaggatattttcttgatttaacaactaattactctatttattatagagacgacggtcaaagaaagcatatttactgtatgcctggtatataggtcagggcttatagtaagtcttatagatacagaaataaaaaacacagtgtttgtcttctttcttacccacattcttataattcaatggcatagacacataaacaatgacagtacctataatgccacttattcactgatggagagtaaatgtaagaaggtgagacaacacagacaaaagggtccctaactcaacctggggaatctggggagggcttcccagggaatcttaatgggtgaaggggttgaggcaggagaaagcattctgggcagaggcatcatcttaagtaaagagtcagcaaaggtagtaacacacgctagaggaagtaggaaacggcttagtaaggcagatggttatgttatgtgcagtgggatgagtctgcagaggatccctgaagccagatcataatggacacactgaagggtttggatttgttcagaaggtcatggtgagccaggaaagattttaagtagaggagtgatatactcagatttgcagccaataggggcagaagtgaaaatgcttctctgcacttgaggggacttgaacatttttgttcacggcttaaaaaccattcattatctagacaattgaaacttttttttctctcttccttctcccctttgatgtttcctggctggagtttgatgaactaaatgaacatggtccagatacacacagctaggtgtgctccacctcacacctcttattgagactctaaagaagatatttgcatggactgtttagtggagaactggagtcaaattcctcattattagcaggacttcaaagtaactaattgagcctaagttaagctgtttttattttttaagctgacattttggttccatttcccagggttatttttagccccgtcacattgtctggcatactgtgggggctcagttaatgtttggcaagtatgttgacagatcatcaccaaagggaaatccacccatccatacattcatccatctatatatctacccttccaaacatctgtcaatgcagtcattcatctatccatcaatccatcaatacatttacctgtccattcatccatctatcaatacattcatcaatccattaatccatccatccatccatctatccgtcaatacattcattaatacgttcatccattcttccatccattaggcatgtttgagcatctcctatgtatcacaccctgtaccagaactatgccatgaaaatgatacaaaaatgaccaaaaatacttaatttttcaaggttggggagagggacacacaaaataactataacgaagaacaataagtgtaaaaatagagatatggactaagttgttggaaagcataagagaagcagtggctaattctatggtgattccatgactggaaaaaggaaacaaagttaaagggatttgggttgtgctgagaaggaagaggaaggaaaagttgagcagctcttgctcatgcacatggagaaaatgcaaagtccaaggcagaaaaccctgaaacatcatgatgtgttcaatgagctgccgtcagttcacaataagttgggggcaagtgggaaagtaacttgggagaggacgctagagacagacgcaggagtcagataagcaagtactatatagactgagtttagacttcatcttgtgtttatttggaatggaggcttgaaatgcaagtttgtaagaggcagatgggcaaacagatgaggctttgtagtaacgcaagcaaggaatagagacgacggtcaaagaaagcaacaggtggaatgaagagattggacagataggcaggcaactgcaatggaatttcagtacaaaaactaccgacaaagaccaccaatggcctttacctcagctagcgaaaataagttaccagtcactctgtacctgctgccctaagttgataattagggtggccaactcactgaggtgtttcttattgagtacaatgagatcttaagccaggtttcaattatccaacactttggggtgaatgtagttcaggttgagtctacctagcgccccaaatgtgggaaaactgaaaaatttagtaaattatcaagaaatttggaaatatccagtttgttatctgtttggaaatgctggatcagggaacaaatgttttggtttcgataaagacacttgctcctggggagagccattcacaaggttgcgtaacatgaactgaatgtcacagcaactttttttttttttggaaacagggtctcactctgccacccaggatggagtgcagtggtgtaatctcagctcactgcaaccttcacctcccaggttcaagcaattatcctgcttcagcctcactagtagctgggattacaggtacctgccaccactcccggctaattcttatatttttagtagagacagggttgcaccatgttggccaggctggtttgaactcctgacatcaaatgatccacctgccttggcctcccaaagtgctgggattacaggcgtgagccaccatgcccagccaaaacagtgattgttttaatcaagaaggtagcatacgcagttgagcacctttctttggatttacttaaaatctccttctttaatttcccatctccatgttctccacttgttcccttttcttccatttggtagtaaaatcagatggaattagcagagtgattactgagacgcaaacactgttcttcagattatatgaaaataactatgcagaaatcctcatgcttcagatttttctgtgttcctctaagattcaatattctgggtgaatgactccatatactcaatgttaatattgtctttttctattaaaagtcttcagtcccttgggaggggggaaaaaaaaacctctaacagaaatttctgctgaacagtaatttcattatgaagttggcagggagcaagtacctattaccttcaattcccccacccaatttctaggaaggacaatccatatttccatgggctttcttcccatttaaacttgctccagagcagagttctttacctagggaaataccattttacaccacattgatcagttcccattaacacctgctgggcacttgtattaaacagtaaaatcttgtcattgttttgcttatctctacaaaattgatcataaagctttagtggtcagataaaatgtcagaaattctgactgcttctaagcctcaaattacagcttcaatatctccatcaggagcaataagtacacagaagcatgctggcaaatagagaaggggaagactctagtgatttgccaagacgacttctgtgttgtcatccactggtggtaaagtgctaagttgttttttattgccagtgacagtcacaacactaaatacatatatatttacatattttatatatataaaaaaatacataaaatacgtacatatatatacacatttcctctggtatttacagtattaagtgtatgaagctgaagtccaggttaaataaacattcctcttccccttgtgttttgtgctctatgaatggtgatgcatggtgatcagagataacattgaaaaataggtagacaatatttcctatatttcctatattatgattgaatataaacggggccagaattgtccaattctcactaggcctgctatcacgttagatagccagccaccaaccacgtgtagctattgagcatttgaaatgtggttagtctgaattgaaatgtgccatccatgtaaaaatacacacagaattttgaagacttcgtatttttcaaaagagtaaaaggtctcataaataattttaggttgatttcatgttggagtagtttaggcatgttgggttaaataaaatatattattaaaattaattttatctgcttctcttcacttttttaatgggctaccagaaaatttaagttacatgtgacttgcattatatttctaatgaacagctgttctagactctctttgtgcttttgcttttgtttttaactggtagactgtaatcatggaagcagggacctcatctgccttgcttagtattatatttctagtgctaaacagggtgtgcgccacagagctggtgctgaacatgtgcagaatgaataaaagaataacttgctgcttctatgttgttgaggtttcatgacatcgaggaaagagaataggctttacagtgagacagtacctggcaccttgggcagcgtatttaaaatctactgagcctccatttcctttttttttttttttttttttgcaaaaatggattaagttaaaccatacagactagccatgacagtttcatatggtttaacctaacttcatagttcgcataaaatgcctagcacagtgcctggtatacagctattaataaatagtagttaacattgatgcaaattttccatgcagttttcactctttttccaccctgtcatattttctaacaccctactacaaatgcaatgctttttaaagccatgcttccccttgccatttagtatactcatttccagagtccctctgtccttgtgtgaacagccaaccataatgggctgcataagcttctttaactatgacttaaaatatctcattcctccagatttctattttatctctttcgtcttatagtcataagtctcctttaacttccaaaatctaattatttgagatgttctctagacatatttattattcactatttcccccttagactttaattctcttactgtttcacaaatgccaccataacccatttagtgtttctcaattttcggttaattttccatctactttgccatttctgaagttcccagggacgtttcctggatcacagtgtcccttaaatgcctccttgaactgcttgggtgtcacagtttcttcgtttgtcatttaatttacatgtttttgaaaacacagtcagttttctttaacctcttttcaattctcaagatactttcattttcacagagtgttttttttttgttttttttttttctcttacaagcattctcctggtgtttgcaaatcccttcaactttgatgtctatcttagtgctttctcatcttccattaactattccctcatgggcgcaaatgaatcctcatccctctttagtacaacttcactctacttttgccagttttcaattcccaactcatccacctcctccttctcttcttcctctgaatatccttgcgctgtcttttgacggcagcaccttcctctttgccctggtgctcaatttcatatacagtactcattggtggtttcctgttccccgtgaacaattaaaaagtcttaacagcagagccagaacttaaacatcaaggcagagaaggccaggcgcggtggctcgcacctgtaatcccagcactttgggatgccaaggcaggtggatcacctgaagtcaggagtttgagaccagcctggccaacatggtgaaactccatctctactaaaaataccaaaaattagccaagcgtagtggcaggcatctataatcccagctactcatgtggctgagacaggagaaccacttgaatccaggaggtggaggttgtggtgagtggagatcgcaccattgcactctagcctgggcaacaagagcaaaactccgtctcaaaaaaaaaaaaaaaaaaaaaaaaaagtcaagacagaaaaataataactccaacacagagatactctaaaatgggctcagaaaccacaacataaagaaacagaaagaagaaaaggatttttataaggagaaaagtattgtttattctttcaacacaaattctattgtggtcaattaaaaaaataatgttagttgtcttggctgagcaatactgaattttaaagattttaggacacaaaatagaaatcttcttaagggcaggggtctttgttctgatcactgcaactctaaaacacctagaagagggtgtgtcctgacttttaagccagagcttaaaagtaactgtggaataaatgaaaaaatgaatgagcaggcataggtctctaggatcctgcacactaaatatttgattccagtacaacaactgccaagaggcaatattgcaagaattggatagcctgagttagaattcaattttgtggctttcaacctcaggtaagtatcctcagttctcagagtatttgtttccttttctgtaaaagtgaggtcataacagccatgtcactgggtaattatagggatcacactaaatgacgtctaatgagatacacaacgtgataaaggccagcagagtgcttggcacattatgggtgtctgctaaactatggtaggggtagcagtagttgtcatggttttatataattgtctttcttcctcctaaaatttggggtcaaaagctttcttttaaatgctggagaatcattttggctactaattccagtccccgaagggaggcaatgagagctcgtctaggccctaccccaaggagagaggaggagctcatttgattgttcagagctcacagcaccccctggactgggcttactggtagatgaagcttctatggtgcaaagcctgtaatccatgtgccaccctgggcatccaactctattcagggagcacacctgagtcaagggtgactccttaaggagaggaccctatatgctgtcttttgtaatacaaccgctatgtctaaaacttgaggtaggttaggacaaagcttttttctgtaaatatgactctcctcctcccaactccacagagcatacctgaaactttgacccaactggccaaagatttcaactagaagcagggtgtatagagtagggtctaagatgcatgtcctaattctactttattgggagttattggaattctgaatgaccattaataaagtggttcttcgaatctcaggctgctcttggaacctggggtgaggaatctggaaatgctgggtagtatttataacactgttaaaatagcaccaaatgcgtcaccattaacctctcatgactaaggatcacctaaccactttgaaccagctggcacaagagccagtggaaccagctcacataatgagcttctaatccaaatgagcagaaaaaaatgtatgtaacgtggcgtgcatttccaagttcactcaatcacctgtgcctatgctgccaaattattcaagatctccaagtggcagatgtgcgtgcatgttgctcttccaaccaaaaactatagaatgagatgatatggatcaattgacattcaattcaaggtgcgatttttatttcagaatttctggatattcacatactggaatatagaattcataaaagcagggattttgcctggtttttccttctgctgctttttctcccttgaagaacctagaatactacctggtataaagtagatgctcaatgcaaatttgtggaatgaacaaaagtctcaactctctgtctttttgttttctttcgtttttccttttgatgatgagccctactttgtctctctgtccagtgggtgtctacctgctttctgtgaattacaactagacatccagtgaggtaactcaaaggcagagaggaaaggtcgggggtgatatgccaatgggactctaacattcctaactccacttacatcgttaatatgttgttcttttttatacgatattatttggggaaaatacatattatatatatatttttgagacacagtcttgtctgtcaccccagctggagtgcaatggtgcgacctcggctcactgcaaactccacatcccgggttcaagtgattctcgtgcctcagcctcccgagtagctgagattacaggtgtgcaacaccacacctggctaattgtttgtatttttagtagagaaggggttggtcaggctggtctcaaactcctgacctcaaatgctccatctgcctcggcctcccaaagtgctgggattacaggcatgagccaccacatcccacgcctgaccagggaaaatatctttatattaatcaattaaacaaataaactagaagacaattaagatatttgctcatccatgctgctacaaaagaactctggtcttcaaatcaggagacctagaatcttgtcctgtctccctgaatatgtgagtaagagcgatcacttaaggataagggactaaaatgtatttagcctctaatatatgttgaatggtgtgccagatactttccatatgttacctgaattctcacccaaagaactaagtgcagattttctcattttacagagagaaaacagaggtgggttttataatggtgtgaaaagctatacgggtcaagagacttctggttgttcatcaatatcctcttttcttctgccttagtaacagaaattctatttttagaggggcacagaacctccaataataaagcttacatttctagcttccctagtagctaggcatgaccctatgacaattttctggataataggaagacagaaggtatgatatgcataacttataggaagtactgtaaaagaaggaggtgagcccgtctttgttccttcctccttccttctagttgcaatgcagatatgatggctggagcagtagcagccatcttgaattatgatgtggaagccactggctgagggtggcagagccacagggtagaaggagcctgggtcccggacactgtggaataccacaccagccctagacaacctttgcacaagaaagaattcaatgcctatcttctttaagctacttttatgttttagaatttctgccatttaaaaaaataattttagctgagttaagcagtcaactggttatttgaaccaaaatctttcagatttcaaaggctttgaattaaggtgcaccagcactcatttaacctccctacacctcagttgccctctctgaaaaatgggggggtggtaccacacacttctttatttttccaactctacaatatttaattttctctcctcatcttcccctactcccatgaatacacaatgcatttggtcctaaccccatctcttagtatatgctgttcctcccacccagaatgcctttctgcctcatcctcttcagtctaaacccagtatttgtttttaacaaggctgatttcaagctgtttcttcattgtggggtttcctaataatctttccttctcttggttctgtttttttttttttttttttggcgggggggtgggggggtgggtgggggtgacggagtctcactctgttgcccaggctggagtgcagtggtacgatctcggctcattgcaacccccacctcctggattcaagcgattcacctgccttagcctctctagtagctgggactacaatcgcgtgccaccatgcccagctaatttttttgtatttttagtagagacggggtttcactgtgttagccaggatggtctcaatctcctgacctcatgatccgccacctcggcctcccaaagtgctgggattacaggcgtgagtcaccgtgcccggcctctcttggttttcttaatccattcctcatgtgacagcacttagcaatacattgcctcctgctattctctgaggattccactttcacacatttggtcccaccaggagcaaaggtcagatcttcccttctgtcatttatgtttatccagcagacttgccattgagcacagcatgttcaccatttattgacttgattcaaaaagggataccttaatctccacccgaggaccaccttttccctacttgacaccaaacacaaggaaggctgagcaaggacaataagccaggccacaaatctttgtccatattatttttctgcagctgtaattcctgttcattccctgcatcaggcttattggccacccctcatgatcatctcaaataatacctcttccacaaagtattacttgactccttcaggttagacgcatcctcttccaactctcaacccctgttcttcatgtggcacacaccacttagagggcaccttctttatttatgttggtcccaaccactcaggactaattttaaaaagacacctctttctgaagaccctttactaccatttgccaaaacaactgtcaaaataaaacacaaatgtttgatgaagctgatatgaagggtgctcctggacttgtgtaattcatagcctgaacaatgttatcacctctcccagactgtcaactccctgaggataagaattcataactcagtaccctgaactctgggagcactgtgagttgcagagagagtggatttagagacaggcaaactgaagttcagttttaaatccacaactgttggtgtttatacccttaaggaaatcaagttattccagactcagctcacttctgtgtcaatgggggtaaggccgctgttttcaccagttcaggctgctataccaaactatcacagtgtgggtggcttaactaacaaacatttgcatctcacagttctggaagctggaaagttcaagatcaaggcaccagcagatttggtgtctggtgaaagccctcttgcctgtttacagaaggctgtcttcctaaagtgtactcacatggtggagagagatctacttcatgtctcctcctctttttctttttctttttcttttcttttcttttgagacagagtcttgctctgtcacccagcctggagtgcagcagcgtgatctcagcttactgcaacctccacctcccgggttcaagcaattctcatgtctctgtctccccagtagctgggattacaggtgtgcaccaccaagcccagctaattttttgcattattaatgaagacagggtttttctatgtgggccaggctgctctcagtctcctggcctcaagtgatctgtccacctcagcctcccaaagtgctgggattacaagggtgagccaccgtgcctggctcttcctctttttataagggcattagttccattgcaagggccccaccctcatgacatcatctaaccctaattacctcccaaagccccacctccagataccatccctctggggattagggtttcaacataaactttcagtccataacaaccacacagcactgttgcgaagtttcatggtggcatcatgagagttagaaggggtcctatgataagcacattgtttttgattgacatccagtagtagtgtgaccaaccatcccagttgtcccagcactgaggtgtttcctttggcatgaaaatttcaatgctaaaaccaaaaccataaattatggaccacaaattaagagtttgatccactaagaaatataccaaaaggacagctatagaaaggcttcaaatctacttcttagtaaacacatcacttcaataaacatccattgaacatctactttatgctagcaaagtataggaattaaagaggtaagtaaaaattgtgtggtcctttctctgcaatcatttagagtttaagggaaaggcagatcctatgcaaataattacaataaatggcaatatgtctgcagctaatgttcctgttgctgtaagaacattaggagggggacctgacccatcagaatactggttaatcttccattactccatttctacttgcttttttcagggcaaacaccaagttgatttatcagaaagaatacaaatttctcatgcttttcagaactgggcagataatatcaatgagtaaaacgagccaggtgcaagatgataacagtggtgaaaatcttagctaaaggcattcaaattcatttaaatgtaaatgaaataaaaccgatctactggctgctcatttggactgtctgttctaaacgaactgaaaaatattcatgttccttcctctcgcaaaaacctaggcttccttctataccagtacagttcacgggactgcatcccttctggggcagagcgatgtgcctatggatatacaataagcccggatcttcgaaaaagtcctcccttatgtatatcagaacacttatttgtttccctggccataaaaatatatacaagggggaggggtgcacctgtcccatggcggatcaattagattctgtctcctaggaatttgaaagttgataggtaagacacacagaccaggaattgttggctctaaaccaatgtaatagtgactctccttcgtcgaggaatgttgcctcaccttatgacctttccaagattagttgctcaacttatactttgatttttaaaaggtctagtaaagccccaaacaatattttctattgtttctccttcattaccttttaattaaattaagctaatcaggctttatttctgttgcttgctaccaaaatgtctttcactttgttcctacctgcactataacatctgtactgctattcagattcctacatttcatcctccatactcatatcaagcccacttgccagatgaaatgttcccacacctcagttctgatcatgtgccacccttctcaaaaccctgaaatggatccccactgtccaaaaataaaatccatgctccttggcaactttaatttttccaaccttccatcctaaaactgttcttaacagtatcctgcattggagcaaacccaaaccactcatggtatcccagtaaagtcttgtgattttccacttcttagcttttgttcctacacctccctccactggaaatgcagtcatagctgttgtttctggttactttcatttcctgataatagatcttcccccacgaaccctggagggcatctctggccacagagattggttcagggatcggtacgtgactcaatctcattcaaacacatttcttctctgggaattttttattgcaactagaagggatcactgtctttctggattaaaaaagtatgtgaatcaatacttagtttagatgagttcattccctatctcctggaggcaaacaactcaccttaacagggagaaatatggaaaggagaggaagacctgaagacaccgtttgagcctggatctagacacgcaagataacaagtccatcctttctagttgaatggaccaataaatcattttgcacttttttgtgcctaagttaacaagaatttactttctctcagtgaaaatcacaaatttttgtttttgttttgttttgttttcaagatagggtcttgctgtgttgcccaggctggagtgcagtggcacaatcacagctcactgcggcctcaacctccggggctcaagtgatcctcctacctcagcctccttagtagctaggtaatttctgtatttcttgtagacagggtttcaccacattgctcaggctggtcatgaacccttggactcgagcaatctgcccaccttggcctcccaaagtgctgggattacaggcatgaatcacgatgcctgaccacaaaagtcttgtttttctattcagccatcgaaggacatttaggtgttttacagtttggggcaattatgaaaagagattataaacatttgtgcacaggtttttgtgtgaccataggttaaatacctaagagtgagatcgttgtatggataaacaatgaaatacaatatgggaatacaaacaatgaattatagaaacacagaacagcttgaatgaattgcagaggcattctactgattgacggaagtgaccctcagaaggttacacactgtatgattctatcttatatgacattctccgaaacccaaaactacagacacagagaagagatcagtgattgtgtgactagagcagaaagtgtggctgtaagtagacatgtaagggattttgggggctggtgtgatggaacggctctgaatcctgattgcagtcatgattatacgaatctgtgtgccaagaatcatacagtcatgcctccaacagtcaattttactagatattatttttaaaaataaaatttaaaattttcattaaaaaataaaagaaaataaagcaaaatcacaagtctcatttaaatacaaagatctgtctcgcctaaatattcacatgttcaaatcctccaaaactgagcagagagtccaccttttcccaaaaggctcactgagcttccagcctccactccctcctcaaaactcccctcacttcctctgcagctccatttccaccttagagtttttcaaacacatacattctcttctttgctggagggtaagctcccgggaaacagggatcatgtctgagccctcgctgcgtgccctcacccctgcacagtgtctggcatgtggtaggcggtcagtgaccatttgctgaatgagcaggagcagattttcatctggccggagctggagtcctgagcagcgttgagaatgtcccggtgtgctggatggcatgtgagaaccatcaggacagagttcactgtattctggcctaaatagaggtctgaactctgccgggcctcataatgaaacttgacagcactatgtacattagcagtaataatgtttcacacccggacatggatttctggtgtggaaatgtgtcccctaaaagactaagctctgcaagtcccagtcactgctctgatattcatatcttcatccataattgcaaggtcaccctcttggtgggagaagagaatgatgtgtttaccacctaaagggcaaaggaactgctgggtggaggaggagttttgttttgttttgttttgtttttctgtataaatggtaaaaagaatatagcttttttttctttttactatagtccttcttccagttttttttcccaaatagctataaagggttaatcttacaactacagagaaataattgtggggagagtaggaggaagagaaagagggaacaaaggaggagaaagaggaaaagaagagaagtcaaagagaagaaaacccaggggaagaaggagaagaagaagacagaccaacaggagagtaaagggagaagtgtgggaaaaggaaaagggctgttttcttacacttgataatgaaacaaaatggagtttgaagcccagcagagcccttcaggaaagctggccagggctgtgtgggaggagatcctcacgtcagtacgatgagagcaagagagagtggcaagatggattgcgtccagagctgggcgagcagcaaacaggaagggagcagtgaggggatgcaccacaccgtggcctggcaccaggccctccctggtgacattgggaaagtaggtcagtttcagagctggctgggggatgaatggtcagccaggagcaagtggtgggaattaaagatgctgagtgagaggttgacttaagcatgggatctaggagacagggagtgttattagtctgtttttcacactgctgataaagacatacctgaactgggaagaaaaagaggtttaatggacttataattccatgtggctggggaggcctcacaatcatggtggaaggcaaggaggaccaagtcatgtcttacatggaagggagcaggcaaaaagagtttgtgcagggaaactccacctttttaaaaccatcagatctcatgagacttattcactatcacaagaaaagcatgggaaaaacccgcccctatgattcaattacctcccaccaggtccttcccacaacatgtggtaattcaagatgagatatgggtggggacaatgccaaaccatatcagggagcttccctagcacaacagaaagaatgaaagccagccctaggttgagctgtccagtagatctttctagcacaatggcaatatatctgtcacatccagtatggcagccactagtcacctgttgccattgagcaactgaaatgtggatagtgtgactgaggatatgaattttccattttattttacttaatttccatttaaatagccacatatggctagtggctggctgtcatatcagatagcttaagtacagagaaaagagctgtgtggatcacattcaaggagaaattgattgccaagaggatcccaaaaggctgttttctgaaatgccttaagtgtatttgagatggtacacagatgcatttagatggcacatgggcaaactttatttttagaattagattttattattttcatgtatattggaaaaatggaactagcatctcaaacccactgtttcatatatatcgttgcttaagaagacgctatggtggaattttatgtctctaaaagattaggtcaatgtaggtaaaaagtactatgttaacaataccacagagggcttacagatctagcaaaaagtaatacatgtatttcatgtaaacggaatcatacactatgtggccttttgtgcctggcctctttcacgtagcctaatgttttcaaggttcatcaatgttggaaaacatatttcattcctttatggctcatattctatagtatggacaaaaccacattaagttcatccatcaaatgtctgttgatggacatctaggtttacactttgggttactatgaacagtgcttctaggaacattctagtacaagtttttcagtttttgtttgaatacctatttttaatttggggaggtatctaactagaagtagaatcttttaggggtagggtaatgaggtggttctgaaactagatagtggtgatggttgtacaacattgtgaatgcacttaatgccactgaattatacagtttaaattgttaaaatggcaaattttttgttttctgtatttttccacaacaaagaatcattttaaatgaaagtaacaaagaaagcaagcagatggctgaatagaactgagctaattcaaggatacaataagtagttgaaaagcagtcatagctgagatatgagatttaaactcatatttgagtctcatatgaagtctcagagttcttttttttttttttttttttgagacggagtcttgccgttgcccaggctggagtgcagtggtgcgatctcggctcactgcaacctctgcctcccaggtttaagtgattctcctgcctcagcctcctgagtagctgggactacaggtgcccaccactacacctggctaatttttgtatttttagtagaaatggagtttcaccatgttggccagtctggcctcaaactcctgacctcagaccatctgcctgccttggcctcccaaagtgctgggattacaggcatgagccactgcacccagccttagagttcttttgattcaatcttctgcccctgaatcatttctacaatacctctggcagataggtgggcctatttttctgcttgcctgcttccatggagtaaagacctcagtacctctccaaaacaaccagtatcattggtgtatagatacacattttagaaaggtcttctttactttaactaaaaaaaaaaaatccatcttgtaattttcacattttatcctatagtccccagaattatccaaaataatgtattcctactatgtgcctggctaacagcacaggagctaacagcagccttaaataggagtgacagcaaagagttagcggaggtcagcccgtgtagagaagtttccaaaatgaccataagctgagtgtggtggctcacacttgtaatcacagcattctgggaggccaaggtgggagaatcacttgaggccaggagtttgagaccagcttgggtaacatagagagatgctcgtctctaaaataaacaaacaaaatggtcataaaatgaatgaaaggaacagtgaaacacagtgattacatgcactagctctggagccagaaaaccttaaatttatatgctaactcagctagttcctagtgttagcgatcttgggcaagttatttaactatccgtagcctgtttcttgatcagtaaaatgggcataatcatagcagccatgccataggtttgtcatgagtataaaatgagaattcatcgagagtcctgagcaccatcccaatccctgtatccagtggctctcattaatattagcccatgaatgttaacaatgccctccaacttaggaacaaggaagtgcatttggaaaaacatagctctacaaaggtctgtctcctaacctgtgatggccatttacccatcatgtaacagggagaagcacatgattataatgtctagaaaattttaaataattctacagaaaaaaacctgagtataaaggttgagtgaacacttttacacttttgggaagtttctatgacttatttaagtgatgattcccacccttagtcaagctgaaaagcagctcctaaagggtgagaggcattaaggtattgtgcttaagagcatgactgggcaagctattcactctgcatcttagttttctcaactgtaagatggggttaatatccctacctcatagtgttggtgggaggattaaatgagttagtacctgtaatgtgctggcacacagtgagcacaaaatatgtgttaactatgatgaggatgatggtgatggtggtgatggtgatgatggtggtgatggtaatgacgatgacgataaaggaaaaggagaaggaagaagaagaatggggaaaaaaaggaagaagatgttggtaattatggcaatgatgatgatggcaatgatgatagataatgatgttggtgatggtgtgatgttgatagcaatggtggtagtgattatggagatgatgctataaatggtgatggcaatgatgtgatgttgatgatgatgacgatgataccaatgtcggcatcatttagtctctgccctttccagaaccatggttccagaaacaccattttcagaacgtagcccctgatgaaatgcatataaaagctttatgaagctgcaaaaggaataatgaaaagataaagcactcttcttaaaattcagagtaagtgggtggggtggggggagggtagtacaaagaagtggttaagaacagaagctttggacttaagagtccttgctttgtatctcagtattgctagttatgagtctgcctctttaattgtgccaactgggattcatgtttaaaatctgcataatggggataataaaaatactcatatggagtatctctgcgtattaaaagggcaatatgcacaaaacactttgtagagagcctggaacatagtaactgaagaataaacattagttatcactggtattaatgggcacaattaaaggtgaatgatctgagccaaggaacaaatgctattgaatttcatatctaaaaggcagtaatagctgtgctgttcagcaaaagtggatgggaggattccaaggcagataattcagctggacccaaatagtctccacatagaagagttttaaggttatctatctaaaccaacagaactgctccctctgcccttggcctcgccatacattgcagaaactcttcccagtcttcctgccagaagattccagtgtccacatgatttctctccacttctttggagggtcccttccactgatagcttaaagtgtcagcaagagtttcctttcactgaaccacagttatttccttgaagcttcaacccactagctctagttctctactgtaagcaaaggagactaattctactacaatttccggatggcagtcctttaaaactctgaagccagttcttgggtcactccttatgagtctcctctagggaaacatttctcataagacacatagtagatatgggtgctctatttcattcaaaaatatacatatagagtcttcactctttttctccagacaggatcttgaatttgcagaatgagattctattccagggacctttatgtaaagatttatagacatttgctacaacgcattgtgcaaccttgtattttaggtcaaataagtaattgaaacaagtttctttatgtttcccctctatatagaaataattaataataatattaaattgagggtccaacatcggctaggcacagtgctgggtgtttaacataagttatcgcattttatacttcagcagctctggaactaagcagctaatgcattcaattgagagagtgtttgcatgtttcggaaattgggccttgtatcctggaaaagagctatattctacgcttcatttacacttcactcatcaaaacactctttggtaagagctatttgatgttctaggtccaactttttttttagcttttgcctttgagaggtcatgttttgcattctttgactcaatcctcaaggctctgagcctgcttaaaatgtagaaggcagataacgtttgggcttgaagtttgaaataacatttttttttccatttctcctttgggagggatattgtatttcacccacaggggttctttttacttgttgctgattttcaaaagaaaaaaagaaaagaacaaaattacaaaatccattacgtgaaggcattagaactgagtgtgaaaaacaatttagaatagaggctcccaagaatgtttgatttggagagaactagaaaatcattcttggttaaaaaaaaaaaaaagatgcagttccagtattagaataaaatcagacactaatttcttccagctaaagtacagccaagagtcaaaatgccaagtcatcatttaaaaaaacggcaaatcttagtatttctttcctggacaaaaacacctaggaagacaataaaactttacagaactgccagttttcaacatgctggcagcaaaacccagcagatgcaccaacaagaaaggcagacctaaaccagcctagcaggggcatcatttggcaaagggacagcctgccaccatactggtttctatttcagataacaaaattgtccaatagtgtctaatagagttaactcaaccagctgtgtggctgacaggcctgcacctgctttcagtatcagttctggcttctgaacagcacaggctattccagttcttctcaccgtgttaaaccacagaaaatttcccaatgcacaagttctgaaactatcttcaacgcatacgcatttgttttgctgtggctcagaagttaggcttattgaagatggaaagatggtcccagagagaacaaagtgggaacgtaaggggctcccagacccaaagctgaggaagacgacagtgaattgaaacttgccattaaggctataacagcttaatcacctggatatgatagcagcagttagacaagccacaaagagactcaactgaaagctgaagcattgtgctacaagacagctaaggggcagaagagccaacagcaacattccccacatgtgggaaggggcatatgtttccatttatttacagcctattgattatgcagcttttttttttttttttttttttttttttttttttttttttttttttaatgagacggaatctcactctttcatccaggctggagtgcagtggcgcgatctcgtctcactgcaagctccgcctcccgggttcacgccattctcctgcctcagcctccctagtagctgggactacaggcaactgccactgcacccggctaattttttgtatttttagtagagatggggtttcaccatgttagctaggatggtcttgatctcctgacctcatgatccgcccgcctcagcctccgaaagtgctgggattacaggcgtgagccaccactcccggccaactatacagaattcttaataaggcaagctgaagctgacggcaatttacaagtcagggaaataagaatcaactggtcaaggaacacatcaaaactgggaggacttgaatcaagtccaccacccttaataatagccaccttccttaagaacagcacagacctacacaactatccaaatgttctaataaaggtagaaaatacatacaaacaagtatttttctgtgaaagcagctttatggtaagattatttatcaaggccattgccccaattacttgtttctacttatttgaacagagacagtgtaatggaatcctgctcctaaaacttgtatgtttttttaaccaatggtaagagatgggactcacaactcacagttgctctgtccaatgaattgatgtaattgatgtcattgttattaatattagaagtacaccatcaatggaggtagtttaggtggtggtgacaagcactgactctggagttaaattatttgggtttgtgaactgtctctgcaacttgctacttatataaactagttgttatttcacctctttgagcctccgttttttcatctgttaaatggagatactaatggcacctacatgacaggtttgttgtgagaattagattgattaataaatagaatttagcacagtatgccagacacactctaggcacttgataaatgctaattactgtagatgtgataatacctttggttgttgttaattaatcaacatctgtacttccttcctgggattattgagagtgctgcaacaatttctcatctgccaattatttgccaactttgtcttctggagttggaggcataagagttaggtcaatctctttgtgtaatcttggttatatgatgtcacctctgtgaacattatctgtaaaattggaataatcccatgcaactcaaagaattgttatgaggattcaagattttgtatatgagtctaaaacactatataacattattgtaataattattaattatgtctaattaggagggtaataaagcaaaatgatcccatgaccccacagatcctcccaacagtcaaaagcttcatgacatgagtccttggaaaaaaagaagagaaagttgcattaaacatcacccaacttctcaagagaaccagaaattgtgagtaggagcttttcatacaccctgaatctgccggcacgtataaatcgaggtcttctcattcttccctcattttcaataccacttattgggaaggaaggtactgaaatgaaaacaatttggaaccaaaaggcacaactctcagagccacagcgatacagtgacaagtgaaatgggctttctaatagtatcctgctgcggattaacagacacctggtattccacctcggaggtggctggtgatgcagccttcttcactaggagtcaacggtccactcctagctctttttccaccatcctcccttttccaacctttcaaggcatgacctcttttccaccagttcctccccgccacccacatcccatatattaacagaagcccttcaaatatctcctccagcttttacaaggcagagatggagttggtcatttaacatatgaaaggaattttcttctggggagttaagtaagtgatgtgaggaagtgatgagcatccttttggcagctactgctccatggtgtctcttggccttcaaacacccaactttcccttttgcagaggtagcgttgcctagtggttcatagcagacactctgaagtgagaaagacccgaaactgagtctaccatgagaataagtgtttttattaccttataaacactaaaatatttcccatctcagggactttgcgcactctgctccctttggctggaatgacttttctccggctcttttcatatctgattcttcacccttcagctttcagtagaaacatcacttctgcaaagaggcaagaggtgtgttccttccatccttcacgttttccatctcagtaccccatatctgcccttcacaggagccataatatagtgcaattattttatgtatttgattccttactcatttttgtttaaattccctatgagattataaccccaggggtcatgctctgttgttttcactggtgtatcccctgtggggtttggcactgaacactaggtaaattcttcagatgaatggatgaatgcaattgtgactgctgtccactaacaatgtgaccttgaaaaaggcacttgactttcctaagcctcaatgttcttacatctcaaaggaggataatatcgcctacctcacagctacttggaaaactggacatggaatgcaccactgttctactgcatcggttccaaaatgcacatcttttgcactttaacttttttgaaataaagatcttataatagctagactcttcagtcaaataaaatatgttaacatctcactcttatacaggacccaagttcttctaactttttaaaaacttcctttggaaagacatggttgtgtggttggatgtgtgtatttactgtttaaggaccaagtttacaccagtactcgtgcgttctgctccacaatttcaacacgtcctccctctcactccccgcctagagattgctccttctgcactctcttaatgagactgtcgttgtacatttttaaaaattttattctcaaaagccccagggagttggaataatgaaacatacttaattaagctatgcaaagcaatcctgccatctaggtggcattttttgttctattttccttggttattccgagaattatattattatataagagccagcattcatagatcacttactgtgggccaggtactgagctaaatgttttacatgctttatttaattctcacaaactcccccactgtgagtggggaccagcattatttctattttactgatgacaaaaatgaagctcagatatatttagttgcttgctcaaagtctcacagctaataagtggcagaaaaagctgaaatttgattccaaagcctgtggatgtactgcagtatctccctatccacagggaatatgttccaagatccccagtggatgcctgaaactgcagatagtacagaactgtgtatgtatcatgtttcttcttacacagacatacatacctatgataaagttcatgaattaggcactgtaggagattaacaacaattattaataaaatagaacaattataacaatatgctagaataaatgatatataaatgtggtctctctcttaaaatactgtattgtatataatattttcagactatgggtaactggaatcacagaaagaaaaaccaaggataagaggggactactgtataggttcgagtcattcaaaagcgactaacatatacgaagcacaaattatgtccattgagaagttttctgtctgaaattaaagtccaaagtatcttgtgcaaaagtgtttctcaaattcttacttaaaatgtcactttgttaacattcagctttgttaaatgtaaccatgtaaattaaagggtataatacatcaactaattaacataatattatacattcactgtaaattatgcaaccaaagttcttttggttgcaatgaaaaaaaaaaaaactaacttaaacaaaattaaaccactacgggcgtttagtggttaatgtctgaaattggagcggcgcggtggctcatgcctgtaatcccagcgttttgggaagccaaaacgggcagattacttgtggtcaggagtttgaaactatcctgaccaacatgatgaaacctggtctctactaaaaatacaaaagttagccaggcgtggtggtgtgcgcctgtaatcccagctcctcaggaggccgaggcaggagaattgcttgaacccgggaggcggaggttgcagtgagcctggatcacgcccctgcactccagcctgagtgacacagtgagactccatctcaaaaaaatacatatatatctctctgaaaagatcagcgatagggtagatttcagataaagtcagatcatggctctgactcattcttcataccatgcttctcttagttcttcctcatgtataaattgcctttatcatcagcctggtttatttcatggtggaaaaatggcagcagaaattccaagtctcacatttacacacttgccatatatcatatagctcagaaatttttaatattagaccaaattagatagtgtgcccattcctgaaccaagcactgtagtgagatgcatgggattattctgattagctgtggtcaaataggacccaccaaggcctgcatggtaaggagaagagaaatggaatctggaaaggcaagtacattttgtaccaccctaggaaaagctggtgtctaacaggagatgaattgtcacagggaaaagaaaaagtgaatgaggctccagatacaacttgggcaagctcagaggtcactgcagtaccttacttccccgctaaaactctccaaagacttttcataatacttgaaacaaaattccaaactctcatcgtggtctctgaggacctagagaacttggctcctctctccaaatgcatgctcctctggctcctgccgttctgaccatcatgctgctcctcagaccctccaagcaatttcccagttccaggtctttgcccttggcagtccccaatccaaaacgctctttcctcagactgtcatattactttctcattcacttcatccaggtatctgccaaatttcaccttcccaaccattctgtctaaaataaccatccttcagtctccatccctttactctctgctccgtttctcttcccatcccatatcaatagcaaattgacattgcctgtattcatttattttctctcttctcactagaataggagctttgagcagcatgcttttttctgttttgtgcgtgactgtgtgtgtctcatacttactataaggtctcacccatagcaagtgcacaatagctgactgttgagggtaaatggatacatgaaaagacaaatgaatgaaaacgggtgaatgcatgaatgaatgaacgaatgaaagaattccaggaaattgctaggtgaacatgggtaacagatgccaggggactgtttttattctgtgtgttttgttttgttttgctttcacctcatcggctgaagacaaacaccctctcccagtcctgcattcagagttctaagaaatgctctcttttgaaagatttattaaagtcaagataaaatttaaactcaagtaaatagctaagaagtatgatggatccctcctcctgctgtcatcttttacactgaatggaaaatatttaccagtgtcttggcctccctgcatatatgtgaattgaatttttttttttttttcagatggagtcttgcttgctctgtcaccaagctggagtgcagtgacaagatctcggctcactgcaacctcgcctcccaggttcaaacgattcccctgcctcagcctcctgccgtagctgggactacaggtgcacgccaccactcccggctaatttttttgtattttagtagatggggtttcaccatgttggccagaaagctgacctcgtgatccccctgcctcggcctcccaaacttttaaaatccaggcagacaagcccattatagactggtttgcacccagtatcacaattaaatcttggtttccttctttctttctaccttttatttccttccttctgcctagtcagaattactaagattcccttgctggggattttgctcaatcctctgtagagttaatatgtatgggtcctcctcaggggtgcacgatgtctcaagggactcattccagaactaatttagagggagttgatggttctgcatttgagcttttgacgattcttataaacattttcccaggaaagactagcttctcccctttattcttctgcctgttttattattggcaatgccaaacatagatccctgtgctaatgacaataataataattagtattgatgacaacattaacattttcagaaaggttttgtagtttataaaattaatttccatcagtcacactttcatgatgaattaactctaaagacaagcaaatgtctcctacccacaagggagagatctttgtaccagcttcgcagcattggaagacgtcctcggaccgcatgaaaacacaactgaccccttttctttcccctgagaagccagagaatcagaagatcgggtgctaaagccagagaggtcatcttgatactgatcctaccactaactgagcctcggaaggtcattcttctctctgaaatctttttctcatgtgaaaatagaaataacactactacttatttcacagagatgttgtgacaataatataagatggtgcatgtgaaaatccttaacataccacctagatcagaataagtgctgtggtagcaattatcattattgacttattcaatatatatttattaagtgtctacactatgctgggtgctggtgcacaaaagtaaaatggacaaggttcctggaattcatcatcatcttcatcaatcatgatcaccttattattaataaccacaaagaacctagaaggtgtagtggaagcaatgcacctaggtgtgggagaaagaaaaactgtgcttctgtcatgcctttgccatgagccagacagcaaaacattaaccctgtctctttggggcctcaatttcctcatctgtaacataacacagagaagtaatttattttgattttgtaaaaccagttgaaaatacgttgttacaactaataatatattttatcattttgaggcaaattttataaattattaaaaacataaaaaagagaaattagactttgatctaatttaaagcagactcattatcatcactcatttgccgtctaatctttcttaagtggaagaaaagggttggagctaccacttacatcctagggagtgtgatgatattgcaaaagcacccagaagcctgctttgtacaaaggagaaaaataattacaagttaatggcctaagtgatctccagcatccctgcctgctctgacatcatgaaatacaattccagattattgtaaccaacaccatcaatctgcagatttaaaaaaaaaaaaggagaatcagaaaagttaagaatcttaacaaagattacaaccatatgcaggagcaagctaggattaaaacccaatgtcttaaatcttagtttgggtcctatttccactacctcataaaaactcggatgaaggcagggaatgtggcttgcctgagaattacatccacgcccatctggacccagttttctattatttttattaggaaacacattcttcatgccctcatacccacaaacctctctgtagacatcaattcctgactgttctgagcagcaactaaccaagcaaagagccaaatgtccctgtgacttggttaactgaagatggaccgcatgcctgagtgaagaacagtttcccaaagaggcttggatttctgccaagggacaacttgagtaaagagtcgtttttatttattcttttacccataggttatttagaagtttgttatttagtgtgcaaacatttggggaatttctggagatctttcagttattagattctaattaatttcaaagtggtcacagaaatactttgtgttagtgaatccttttaaatatactaaaacttgttttatggcctagaatatgatatatcctcataaattttctgtatacatttgaaaaatgtgtgttctgttgttgggtggagtgttccacaagcaaatattaggtcaacttggttgtgacattgttaaaatcatctgtatctttactaactttgctcgttctagcaattattaagagtattgaaatctcctactataattatgaatttatttccccttgcagttgcatcagttttgcttcattattttgaagctatactagatgcatagtttgatctttttgatgaattgactcatttatcataatgaaatggcaatatttaatgccaaaaatcttcatgatctgaaatctacttagtgtcttattaatacagccagtccagttttttaaaattagtattagtgtgtacatatttttccatatttcaactttcaacctatttatgcttttatatttaaagtgggtttcttatgggcaccttagagttggttcttgctttgtgatgtttatactatttacatgtaatgtgattattaatacagtaggtttaaacctatcatcttgctatttgttctatctaatctttgttctctttttcctttctacttaccttcttttgataagttgaatattttttatcattctgttttatttcctttgtggcttattagccagagcattggggtttttttaatgttagtggtttgtttagagtttatagtatatattttaaatttatcatggttatcttcaagtgatgttataccactatactacgtaagtataccataagaccttcaaatagtatactttgatttccctgctaatctttgtgctattgttgtcatatttacttttaacaacctattaacctcatgctacattgttagtatttttgttttaaaagtaatttatcttttaaaatgatttcattgtttaaaaatcctcatgtgaggctgggcatggtggctcacgtctgtaatcccagcactttgggaggccaaggtgggtggatcacttgaggccaggagttcgagaccagcctggccaacatggtgagacctcatctctactaaaaatacaaaaattagccgggcttggtggcatgtgcctgtaatcccagctactcaggaggctgaggcaggagaaggtggaggttgtagtgagccgagattgcaccactgcactccagcctgggcagcagagtgagacttggtctcaaaaaaaaaaaaaaaaaaaaaaaaaaaaacaaaaacctcatgcgtttaacaatctagtttttgtttaattgcttttcattcttttgtgatgatccatattctgtttggtattactttctttctccctgaagaacttcatttaatatttttttgtaatgcagatctgctgctaattcttccagttattctattctaaaaagtatttcattttcactgtggaaagatattattactgtgcaaagaattctaagtttacattgttttctttcagtacaaaatatctttctgcattcttttctaacctgtattgtttccgacgagaagtcggctgacatcttttttcactctgacagctttcaactgtggtatatctttttagctgatatatctttaaaactgattttgagaaatttgattatgctatgtcttcatatttctcattctcaggatttaagttttttgaactgagggtttatagttttcattaaatttgaaaatttttcattccattatttttccaaaattcttcctgcccccttttacttcagggattcaaattaaacatatattaaaatcctcagtcgtgctcaatgcatagttcaattgtgttttctctaagagtttcatttggggaaattactttgttttcaagttcactgatttttttcttcttcaatgtcaaacctgccattaatccatccagtgtagtttttatctcatgcattgtagattttatatctagtagtttgatatggttctttaaaaaacattctctatgtctccacttgaatttttgaacctatgaagttgagagttagagttactctctatagtaatagccccatgtgccaattccaacattcatttaaatctgggtaagttgttacatgatattttttcattatggattatatttccctgctgctttgcatgcctggtaacttttgatgggatggaagaaattataaattttaacttttttcgtgctgatatttttgtattactataaatatcactgagctctgttctagagtgactaagttacttggaaacagtttgatcttttcaaattttgcttttgatatttgttaggcagagtgagagcaattcatagtctacagctaattatttctccattattgagacaacccccttctgtgtactcaactcagtgcccatgaataactgggttttctagtctgactagcggctaaccctcactccacgtgagtcctgggctctgttattttcaatctttgggaggcttctttctttggctttaggtagtgtcctcacccttatgttgagcagtattcagctcaacactaaggtgggccttaggcagatctccatttacgcggatcacttttctcaggtactctctcctatgaaatccagctgcttttgtttcctagattcaactttgtctctgccattcagggagtctgccacacttgaatcccctatccttaagttgcagcctggaaactctctcaaggtggtgagtggagccataaataaaatgtggtaaactcacttattttagtttctatcttcttttccccaatattcagggtcttaaaaacaatcatttcaaattttttgtccattttggttgtttcagtctgtaggggatattacagtccatcttggtctgaagtagcagtcaatagaatggaattcattgaaggtaaataagaccattaaatctctcaaacatatctccaagtagttagaatttacaaaccccaaatttatttttaaagcaaatattgaaacccccagtatgactaagaaaaagaaagcagattggaaccaaatactttactacgttaaatgacacattggaaattttcaagacaatttcttaagcaagtaatacgggttccatccggctccatcatttgccattcacttgacaaatgtcataacgccactgcacaccccaccagagcaaatattttcttccaaccttaaaataacatctacaaattaattcagtctgtcaaggggaactctccttgggtaattcaggaagtttttgcctttgggtaaggcactctaggcacaaacaactcaaattctcacctgtaagttgaaccaagaaggaggtttatgatctacagctacatgaaatgatcacttagtcgcagatgactatgtaccagacacacccagctgtaattttgaaagccaagttcattttactttgttttgagaaaatgtgggcaaaagattagaggcgcctctccaatcttgggaagcctctagtcatggaaaatcatatcccagcagtgctttatatgatttcacctgcagctttaagtaagaatgtttgaccagtaatgctgtaagcatataggataagagagacctatgttgtacacacttccagttgtgctaactcaggtatgaagatctctggaggtgagctatcaaaactccctgttattgctcattctaatatctgccaatcttaataatcatcaagttcttgttttggaaataaatacacataatgatgattatgataaaaataataaaaatgagtacaagacaacctgggataaaatactttaaaaagccctggaggtaacatggataaataaaccaacccaggtggggactaaggtgtactgcgcagagatgacagtcacttccagcttccagttgatcattagcaggtcaggatatgggattattatcactaactccatctttttcatggtaaacaaaaaatataatttttgtgaaatctgatgatagtgtttaaacattgggactttacttttggaaacaggaaaaacactctaagtttaaaaaaaaaaaacatgcacacaacacaggtcaatttgcagcctctgaaagtcgtaacgtggggtttggaaccaaaggaaactggatttaacttctggctccattttacattacctgtgtggctcttttcaagttctataacttctctagtcctgtttacttatctgtaatatgaatcatgatttttaattgacctgctggtactctagcattcatttacctctttctcattgttaacagaactcaaattttattgagacttcatgcctcctgtaagaatctatggaactcaagggaagtttaccccattcccagctccaggagtaggtctggtttgatttaacctatttgccttctctgtgactgggtcaggagtttggagttaagccagtcagtacctggcattttcaaaatcaccattattggcccaagatgggtacatgacctaatttggccacaaagaagtcttcccaggtgttaccagcaaacttgaggtaacgaggaagtcagttagagaaaaaaaatcacactgcccaaaaagcagagtcaagagatcatagagaaaagaactagaagcttgattatattgcacctgaagtccaaacttcttctggaatttttgttacgggaactaattcaatcacataactttgagttaacttgattgctacctgcagtaaaaacatcctaactcacatctaaggatgaaagataatatatttaaacagattgacacataggaggaagtcaatacatggtaggtcttacccttagagtactttcacgtttaaaaatatatatgcttagataatataacctatgaaacttgaagtttccccactcaccctcacatacataatgatgcgttgattaaattaaattgtttaaacttcctcttattaatagtgatggaaatgaaaaggaaatgagcacatttctcaggagagctattttctatcacatggaaaactgggcagtgtggatttactctttgtgtttggccaggacttaaccaaatgaagcagatcctcaggaagctgactgtggggatttggacaatggtacaccagacaccagcagatctgccagttcatttacccaactttgaggcccatgtagaaatgtggctggcctcccatgcccacgcagaacacagctagcaccatcacgctggaccgtgactcctccatccctaagattcatgccaggatttgaggcaccaggaacctggacgggggctcattcacacctgcaggcaggcagcatccacatggaagcaagaggtgagagaagcaaagaagcaaggagacaaaggcagagaacaggtggagaggcccgttctgcctctcttgctcccacctggaagggatgatcaggagagcttttggcctatatatagatagaggtgcatagacagatactctttcaggaaagcaaaccaacgatagctcataagttaatcggtcgtgagcacctgcccctttatactttgctgcatgcttctcccttttggtagaaaggatttttaactttgtctttttgtacaatatcagatgttgcccaaatcgtgtccagaatgaaacaaaaacagaggttttccccctgcctgaactatcactccctcatctctccagaccccaaaagctccatcgcctcctcatctctccagatccaaagttccatcactcgtcacttactcatctgtccagaccaaagctctatcacctcctcatctctccagactcaaagccccatcacctcctcatctgtccagatctaaagttccattaccttcttatctctccagacccaatgctccaccacccatcacctccctcatccgtcgagacccaaagcttcatcacttccttatctctccaaagccaaaacttgacttgccatactttctcaatgtactgattaaataaaactgccggtaggattaactctgcaaggatgcacccaacccagatatattcaccatagccatagattacacatttttggaaggcctactacgatgtctatcatggagcaaacactgtgcagacgcccaccaggcatcaaaacaaaatcaacattgggaacagagtctccatgtgggaagagcacctggaatttacagcgtaactctttctctccaacattctcctttcccttggaggattatttaccaattaatgttaaagttcctcatggtttaaacccaggccctcctgagtcatcattctcccctgcaagaccttgcccagtcgtagggctttgactgccatcaataagctcaaatcctgtgtattgcattttcggtttgtactcagactcttctctctgattgcctactgagatttccacttggatatctcaaaagtatgtctaatttaacatgtctaaaattggatgtccctgactctctgttccccaacatttctttcctcatttcttctgtttagtaaaagacaccaccatctactcagctatacaagaggaaaattattattatagctcttttaacacctcatattcatctgtcaagtcttgtcaattttatagcccaaatatgcattaagcctgcccacttctctctgaatccacagctattactgtaatgcaagtcaccacttcctctttcctagacctgtgctatgatctcccaaccagcctatgtttctacacattaaagcctcccagccccagtatacactctgttagcaggcatcagagtaatagagatggggcttaatttgctttgttttttcacaaaagagagtggcaacaaataattagcacatgtcaccaaattactaaatttcaaaatgaaaacttctctagtattcatccctggaggaaatagatcaatgtgcctttttgttcggcattctggttccaaaatcctaagacttacatctggcctaaggcaaatgtgaacaatatttgtgctttatgtgtgaccccaaaacaacccaaaccacctttccctcaaggtaaaggcacggccaacttctggtcctcccaagctgccagcatcaggtttctaccatttgtcgagctattcattgggtgccaattggaaatgattgacttgcattgcagggctggcatacggttcttttgacttccagccataaaagggagggctgtgttccaggagagatgccacaaacagagatgatgctgaagagaggctgttgacttagtgctcaggctgaacacccagcaagctcagcccactctcatgggtccatcaggcctagatcaagctgtgcctctagtccaggagaggaggagaattaacacctgtagagtgccgactatatcctagatgcttgactaagcacaatacctgcatttaagtggtatcatcctccctattcttggaattttctctgtttacaatcaaggaaatggaggctcaaagaagttaaggaactctcccagaataacccagataataagagggtttgaacacagcactgtctaagtctacattccacaaagtcacatagctttgggaaaaatgatttgtgttcctctggattctctcacctcgtatctcttgctgatttactttgagactcagctgtttttcccacttctgagttcagagtcccaatcagatgtacagcaaaggcccacaggacagcttggcctctgaggtgcctgatttcactgcgagaagtgtttgttgagcatatggtgatctcccagataaatatttgcaaagagttaatcacattcacctagggaagttttaactctggtcaagctcagagaattaactgagcaggcatttctattggcattacaaaaaaccaacagtgatcattctgattactaaataaaaatatgtcaaccaggtttagcacagtctcttaatgggtcattaaaccaagaatttttcctatgttattttagaaatgaagatttaaagtagtatcaatgtaacttagacatgaataaaactctttctcacatatatatcttccttctatttccctttctgcaggggtaataatttacaatgttgttggtttttaaagctgaagcctgacttcataactcaagaagtcaatccaaaacacataaatggtcatgccaggtgtcatcaatgaaggccaaataacttcccttcaatactaattcataactctcctgggataagactttttttgccccctcatttgtgctatagatctacttgagctcttctacttgatttccagtgcagtaacttctccatgtcctacttccctaactaaaatgggaaccacacagaacatacagttgtaattcagtaattaaagaatagaactgaaatgcacttccattgcttgctttcctagcttactcagagcttgcagtgtaacaagtataaagttataataatgatgatgatgaccacaataataagaaaaataaaattataataatgacctgatagttatttgtaaaatgccttctccatgcctggcaccatgctaaatgtatatactttaagatgttacaagaagaagagatgtctatcttacacacgcaccctctttaggaaaactcctgggttcacagttgttaataacttatacttggtaaatatgtggtaaattcatagtcaagtctgtcatactacctagaccatgaagttttcttgatgccacactgccctcttcccaatggccatatttctcccaaggtaatcctttggtaagagggttttggtctgaaaaacatccaccctctcccttctatgacctcctcttcagtaagtgtaaaatgtgtcccctccgctgtggaataagaaacacatatatgcatgcagagagaaagacacacacacacgcacacaaaaatgcaggtaaacgtgtgcacatgtgtgtatatacatacccatgtacatatatgtgtgcaaaaacacctgtagacattcacaaacacacagcactcacagcacaaacttaatgctttgcatttcataaaaccacaggctaaaatgtgatatgaatttcacctgggtctatatgcttgaaccaagccccaaataggcattagtggctagagctttaagcaccagaggaaataaataaaagctaccaaaaagcagcttggaaaataatcacagagcattgagtcacccagatcctactcctcttgttaggtgctgtgctttagcataaggacatttttctttctcctatacctccaacttgggaggctgggcctctactatggaatattccactggcccccaaacctcagagcaaacaatagatgaatgacagccctgccccgcctgataatcacatgatggcctttttgtgtctctccaactatgaataattggtgcttagcttatgtaagacaccaaagacattttttgaatgaacaaatggtaatatcatgggctatggcatgaagagacacttacttcactcataactttatttcatttttattttattttattttttttgagagactgggtcttgctctgtcgcccaggctggaatgcagtgacgtgatctcagctcactgcaacctccacctcccaggttcaagtgattctcctgcctcagcttcccaagtagctgggactacaggcgtgcaccaccacacccagctaaagtttgtattttttttttttagtagagatagggttttaccatgtgttggccaggctggtcgaactcctgacctcaagtgatctgcctgcctcagcctcccaaagtgctgggattacaagtatgagccaccacgcccggcctaataactttagatctacaagtttcatccatagtagtaaccatttacagactgcttttccatacgccacacactggtctaagatgcaaatgcttttcttgtccccatattacacctgagggagccgacgtggagttcagtgactcacccaaggtccgaagtctaaaaaagtacagattaggttcgaacccatgcaacctggccccagtgcccatgctcttaaccgtgatgccactgcctcccagggggccctggccactcctgaactggacagattcttgtgatggaaccggacacaacagccgggattccaccagccaaacaggtcatggtttaccttcacaattttgggagttaacagtgacatggtctgtgcttggtgaaggaacagatgtttaataactgtgcagtagcaaggaggttatataacatggctgagctatttttaaactttggaaaatgctgactgctcttttcaaagtgtcttctgtaaaatcaggaatattaaacatgaagaaaatgtccccctttcctgtacttttttttgcctgaaactctatgtacagaaacggttgggtgtaaggtcatgaacataccttcccttgcaagcagcccctggtaccacgcccagcccatgagcaacaatatcctaactgcaccagctctttgcctgagattataaataaagtccatgaggaccaccaagtggcatgtctagctggccccatgactttgttctcaaccagtcaaatctggatcccagatcccctcagtaactcaccacgaagatatcaggtatgacctcatctgaacttcttctggagctatttgcaacctccctgctacataggaggaatagtgagagctatttgtttatcagatgctttgcagagtaagaccttaatccagctgcaaatgtaatttttaagcttgaagtgaagaactcctaactccagagtcctgggcttctattgaacaagctggtagatctaacacaggctacagataggtctgttctctgctttcagctatccagactgaaaaatatcttactataaaaaaacctaaatgtccatcaaagaggaattatgtaagtgtaaagatggaacacttatacaacagaatatcatcaataaaataaatgcaattgaattatcttcatagagggattttgaaaacataaggttgaggtaaaggaagttctaacacattagacaccatttttgtacgttagacagaagtatgcattgggaatacggttgcacatgtatgtgtattgaaagtacgaacacatgtacatggatttggatgtaaaccaaactgattatcatgttttcccttctatggagagaacaggagaaaactgggacagggaaacagatagaatcagaacttctacattatcattaatgttttattgctttcaaaatgttgaaacaaacattaacctttggcaggtttagctttgttccctatgatgaatatcgggttgagtattttatcagattctgttgttttctgtactattcttttttcaatattaaaaaaagaattcttattcctaagtttgtctttagataaatttcccccaccttgatcagactgtatggtgtttgaggagagaaattatatcttaattcatctatgtatcccaggggctagcacagagtctgttggttggaagcaatgatagacagaggatagaatatagtgccttgaccaggtgtggtggctcatgcctgtaatcccagcactttgggaggccaaggcgggtggatcacctgaggtcaccagtttgagaccagcctagacaacatggtgaaacctcgtctctactaaaaatacaaaaattagccaaatgtggtagtgcgcacctgtagtcccagttacttaggagggtggggcgggagaattgcttaatccaggaggcagaggttgtagtgagccgagattgtgccacagcactccagtctgggagacagagcgagactctgtctaaaaaaaaaaaaaaaaaaaaaaaaaaaggagatataatcctttttgtttttttgtttttaaatgctttctttggcctttctctagctccctgtcaagggcagcctggcaggtttccactattccctggggtgggcgtcagggaccgtgggagagtgtgggaaggagagactgcttgtgccttatccaaacttacacactgggtggacaccaccagccctgcatggatggagagatgtttcattaaacaccaagcagtggatggcgacttaccacgcttgatgcattgcttctctggggctgaaataccatttacaaaattactgtgtttaaaggcgtaactttgggaaattgcgcaacagcatttcacagcagcagaattttttaaaaaaagcatagaatccagggtggtcactggaaagggatctaaatgtcttgccaattatccttctagaattccttttcctgtatatgttatatttcaattgccctaaaattgatttatgtttccatcaaaattatatgtttctgaatattccagctgcagggcacatattatgatggaagtgagaattcattagcctcgtttgtgtctttgggctggcagcaatcctgcctctgtaagagactcccatgtctcatgctgatttatctgagttccttcctgatatctggacaattatttaaaatgctgaaagtggcagtgtagaaacaggattactaaagagagtaaaaggacagaggacggagaaatgtcaaaggagcatgatttcttaattcaaggttcatttttcagatttatgttaattgtaagaagtatattctgtctacttcatcacacacacacacacacacacacacacacacacacacacacacacactcctccagccccagttcagagataacctctgaactgtagcagattcaaagtcctaaagccttccagaaatatttcagagtgacatagtaccctgctggtaataaaccaacatggtttgttgactgtatttcccttttattattattatttttttgagatggaatctcactctgtcacccaggctgaagtgcagtggtgcgatctcagctcactgcaacctctgcctctccctcttgggttcaagtgattctcctgcctcagcctcatgagtagctgggatcacaggcatgctctaccacacctggctaacatttgtatttttagtatagacagggtttcaccatgttgaccaggctggtctcaaactcctggcctccagcgatccacccacctcggcctcccaaagtgctaggattacaggcatgagctaccacacccagcctgctgactgtaatttctgatgaccaaaaacttcactgatcactctggaagttatttagtattactatgtggtaaataccgtgctaaacagtacttttcatgcggcacctcaatgaatatgacaatctctagaacattggtcctcaaagcacagcccctagaccaagaacatcaacatcacccaaaaacttgaaagaaattgcaaattctctgggctcaccccatattttctattacattagaaactctgagattgaggcccagtaatttgtgtcttaacaagtcctcccagagattctgatgcctgctgaggcttgagaaccactgcctagaaattaggtgctattatcatcactttgcaataaacacctgaggcccagaaaagtaaaatgatgtgcaagtcatacagaaagtggacgagacaagctttgaacccagacaagtctaactccagagttgaggcccttaatcacagttctacactgctcattatctgaggaataaagcgtggattaaatcagtgaacatcaggcaaaaccatgcaaaattgggataggagtgatcattctaaatctcaacagctgaaccataatgatgggccacaaggaacaatgacacttctcagaaacctaaaatttaacttaaatgttcgccaagatgggagtagctaaataaattatgatacattcacataatggaatataatgcggttctgtgagtaatgtttgccaagatttccaatggcctacaaaaatacttagaatataagaagggaaaaaatcaaatgcaaaatcaaacagagaccaggagcactagtgtgggaagtttccccaaagcgtaacatgttggtgaggatgtgggaaactgggtagtttcacaaactgttgttgtgactataaattggtgttgttactttgcaggacaatctggcaatagatgcttccatttaaaaatgcacatgaattaggacccaaaaatcctatatcttagaatcaaccctagaaaaaacacttgcacatgtgcttagacatgtataaagattatcacagctgtttagcttctaataggaagcttcaaaatccctaaattaaatgtttataagacaaatgatgaattcttgaggtgatgaaaaccccatttaccctgatgtgattatcaaacattgtatgcctgtaccaaaatacttcacttatcccataaataaacacatttttgtattgggggttggggcgggaggtggggatgatcaatagggtaaaaaaaaacatagaaagaatgaataagacctactatacgatagcataatagggtgactatagtcaataataaatgacttgtgtattttaacataaagaatataattgaattgtttgtaactgaaagaataaatgcttaggggatggataccccattctccatgacgtgcttatttcacactgcacgcctgtgtcaaaacatctcatgtaccccataaatatatatacctactatgtacccacaaaatttttttaaataaaagaaaattaactcgtaaattcctaccattatgcagactggataactaaatcatgataccatgatatcatagtgaagaatgtgatgagggctatgaggttagacttatctgggttcaaatctttatgagttacaaaaaatatagatacacttgagatacagccatagacagacagacagatcgatcaatcccaggtgtaggtttccaagatatattgttgagtagaaaaaaaagttaagttgcaggaaacaaagtctaatgtgacttttcttacaaaggagatgaaagaaagagagaggagagcaaaataaaagtcccgtaagtaaacacataacattctgcattttcagtgcgtatttccaacaatgagtatgtaagcaagcaaacaatgacaacagcaaaactctgatcccactttgggagacaacaagccctttcttacgggtgcaaggtgtgcatcgggacctctggcctctccatctgcccgtagcagctggccttggcctcggggatgtaggagaacttctccagcatagaagatgcagcggtggttaggatgccaatgccgtccctcactctcgcctccaggctgtagtcccagtcatcgtaggagacagaaatgagtcccgatggaaactcttttgggatgagctccgtgttcccagagaccaagctggggacaatccagaagaaatcatacccggtgaggccaagggagcgggcctcactcagaatgagaacagcctcgtctttggaacagtagagcaagatgacagaagagtggatcttcttcagctggacttgtgtctttgcatcctcaaaggaagtgtccagtgtgatcacattctgcatgtcccagcccacaaagctgttgtccactgtggtcttgacgaagctgatgaattccctgtagccagggaagatagtggtcaccagggagaagacatgccagtcataatcctgcatgatcttcagcatgaccgtggcttgctgctggatggacgctccaaactggaagaaggtagacgtcggatcctgccagtgaaaagaaagtaaaacagaggatgaggcaggaggtggtttatatagaagcacaaactgcgtcctagaagtaaggaaagtaaatcacacatcaatcatttgcagacattcctgagcatctactatatcccagactccagaacagatcctgcaaatacagagaggacagaagcccctgtactcaggagctcatagccaggtcctggaaggatgtctgtaattattgcttgcttatcatctattcttctcattttcctctagttcgtcctgccccttcctcctttgagtctatatggttctaacagaacaaactctatctgacccccaccccagctcatgaccggaaaatcaagccacggaaataaaacagcatcagcaaagacagttttctaacgatatatttggagcccctagagtctgccaagtatgaagccatttctcctggacccctttgttatacaagccagtgagtttctatgttcatttaaggagtttgagtagggtttctgtcacttgaacatacggctcccacataatacagagtatcataaataccatgtggacatctaccttttcaatcaacaaatatttatcgaacaccttattaagtgttcttaataagaattaagtggaagacaacttctacaaactaagagctaaaagaggtatatgaagtgctgaaggagaatccaggtgaggaagaggagaagtgcatggatgttacagtcagaggaatcccgaggatgcactgcgactatctcagaagctgtagatgaatgcatcatggcaccgaaaggaggcggacgatacgatgttgaagagcttggcagaaatccaagcacatagggcctattcagagcataagggagagtcactgaatgctctcaccctagaaagtggcatggtaacttatgtcaggttaaagggcctctattagccctaacatctccacccatctacgattgtgagaacaaatttccatttagaaaaggcaggtgatgcatacagtggtacaatatacaaactgccttcataccccctaactcatcaaatccccataatgatcctacaaagttggtattgctggcagggaaaacgaggctcaaaacagtcacagagcaagtagacatctgtacctcagtgccatgactctgcatcctgccccctttctgacactcaatcacagtcttcctgggatcactgaagatctgtatggaacagatgcttaaaccacgttgttgacttgtggacatggtgcaaaaatgccaactaaacagaaggtatgcctctgtgttagagcaaaacaggatttgagaagtgctgagatgtatttctttcagggaactgaaagaattatcaaaaggtcctcatcatattacagccatgtttttattttgcgttctgtatttaccatgagtattgaacacaacctcaacaagataacttatggggattccactgagagagagagagagagagagagaaagagagagagagagagagagtgtgtgtgtgtgtgtgtgtgtgtgaaaggtggatgttccattcatgtttttcagaacaatactttgtagctgtgcatgtcaattccttcaacaagtttacatcactttccctgtgggtgctcactaaaagttctatcagaatgggccaaaagctatagttcttcgaaatactgctcttttctgaaatgcatgggtttgggggataatttgagtgaagcatggcctgaaggcagagaagaaacaagaataaatgtcttctgggccccttccaacattgcagttccatgaattttacctaattaaattaattaaagtgggtaatagatttaaagactttggataattattgttttccctacagtagcttttgcagaaatctaatattcttgaattgattaaccattttaaatcacatctcaacaagactgtgagctcctcaagggcagagatttttgttgttttcatctttatgtccccagaacctggcagaagtcttggcacacccataagtggatgacaagggaatgaagatgtgaatgaagcctaaaggactgtccttggttaagaccagaaatggaaagaatgggaattcagtatctgagattgtattttgtgtggattctgaatattgtgtccaaaacaaaacaaaacaaaaccttcaagatcatcacctacaccttcctaccctgaggaactacccaaccatccaatacccaacctatatctcaatgtatcctttattgataaagaggagaatatagaagacctataaacctcagcagttgtccacagaacttcattaatgccaaaatagggcaacaagataaaaaaaaccaccaacagaagacaacacagaagtagagtctaaaggcaattatattcgccaacctcacacactgtgagacgcctcttgggatggggcaaaaatgttctaaattacaaaagaaatgtgatagctcccatgtaaatgatgcctcaaaggaagccagtcaccagagttaccttctgactgcaaaaggtggtggatcagcatcttgcactaagtacacaaggaatacagaaagctctcaacaagacacacgctaaaggcaccattggaacctaataaaaagggtctatgagacacttccttgggaagattggtactggtggagaggtggaggtcagacatgccagatggtgatggaatgtgggatcctccaacacccttgctctatgtactctgagctagacatgaccagggtacccatgaaaaggtctgtgcacagagcaaagctgtaagcacacgcatcttatctggttctctacatgtagagaggaaggcatggctgcactgtgaacttcctcaggagaaagataattggagggacagcagttaattggcccagagccagctcggcacaggccatctgtgaaagagtaggtgcaaaaacccttgctttgtgctgtctccaccccctgtcatgccaaacttcagcccaagctgaatctctcccattacccactatgctgatccccattcgcagcctctctgcagaaaatggagaatactagaacctctggggttggactacccagctccaatcctcattatgtggccttggatgggggggaaaaaaaacactcagcctttctaagtctcagttttctcatctataaaatgggtgtggctatggtaataatgatcatagtaaacatgctagaaatacttactctatgagagtcacgttgctcctcactttctaggtgctatctcatttaatgccacccccaaccaccttattaagttggcactaatagtatgcccattttacaaatgaaaaaagacccagaagtagggtgatttttccaggttcgtacaggtagaaaatcaggtttgcctgccctcagggtctcgagtttttacctctgcactctgctgttgccaataatggtgcttcctcattaagttgtaggaattaaatgattctcttgtatcaaaacacccagtgtagtgcccatcaagtatgaagtattcagcaaatatttcacatcaggagatcatgctatcttttgcaagaggtaatccacactctggacttggagcatctcaacaactcaccctgttcagagctgcctggttgaaactcttaaagcacccctttaaccatgccactgccctgctctatagtcatcaatagctcccataggcctaccatgttaagttcagactccctagcctacccatctatgtgcaccagctttatagttgaaataccatgagctctagggtctattgaacctaaattcaagtcctgcctctgagggactgtggctaacctagccagccccgtggctttgaaaaagtgcttaatctttctgggcctgagtttctttacctataagataggaataatgacccttccatcacatgggtctgctgtgagaatgggatgaaaaggtagaagtgggagactcatctgtccacgcctgactttgacagtttgggtgcttgtctccacatcctcggtcctacagaccacacagacatcgtcagaaacctaagagggtcctcatcctatttcaagaactggcctctccaggtccactgacatgctggtttcaaatccccaccaccccatgcaaaccagctcattcattctgagcccaaggagcctgtataatgcaaagaagaaactgcctttccatacagcaatgaatccatgctttggagagaaaccatccctaatgtccttcctgggcatcatgcagttaccctgtactactgtcatttctattggtatcttaaaattcaacccaaaaaccaccatggaccaaaagcatcatctaccccttggagggacagaagcaagggcctatttgcaaaatataattgcatagcagagcaatgaagaggctcacatttaactttgggatttcctaaggtgattttatgaactggcaggacatgatggggaatctggccacactcccagggcctggcgtccaatatgccaaatagcccaaagcccctgaacatcctttccactccctgtcttgatggtagaggccacctctcctgcacttacctcctcctgccatggctcagcctgtatttttcggattctacatatcagcctctgaccacctctggcactcggcttccttagaatgtgcagctgggggagaggaacagatttcatacacccactttggttctgaagcaaaagcacttctctccccatgctcactgctctgcggaagacagaacaaactgttttaaacacagagcgagggaggcaggagggtgtgggattctgggtgtctgctctagactctgtgtttcagtaccatcataactgaggactcattcaatcaggtctagagcattcaatcctgttccagaatgttccagagcttgctcggtccccagggtgacacctgactccatgggtaccaaagcctggtgtttcctagagcataatagcaacttacattccatttacccattcataaaggttacaaagcccatccacacccattatctctttgatcctaactactcaagagataacgcaagtggcataacactcatggatggcatttctcctaaagacacaggatgagaggttaaatgacttccctgagatctacatggccccatggtgatggcagctcagtcatcgtgagatgcatccagttttcccttgctcacatcagtggctctcattcctggctgcacatatgaatcccttgaagagttatcaaagaataacctatgcattgtgccccatgcaagtctgattgaaagggaatctctgtggcctgagtatctgaactttaaagctgatttattagtttttcctctgtctcttctcaacagcagtatggttgagaagtaggtattcaagttagtatctttaaagccaagtacaatgtctgacacacactaggggcctgataagtacttggggaaggatgagaggggcaggaggcttacacccaagaagcatgagagaattggtcactattgtcaaccccacacccatttccacaacttattttcctgctgtctgccaagaaaaggaaataatggaggtaactcagcaacgatccagagagactcctggggaatttgcattctcctgttgaggactgcccttgtgagccctggtaagccctgatgtgctttctgttactctcatagtgtatcaactgagcatttcaacatattttatttcaatttccaggggtgagaggaaaagtaaaaacatcaaataagcctggtaagcctgaggattcagatggatagcattctcacgtgcacataagctgaattggtcacactggaaaacaactactccaccaccacccacctccctcccccttcctctgtcatcatcatcctccatcatcatcacatccatcctcctcctcctcaccatcatcatcatgaccatcatcatagccaatatctctcttgggcatatccaatatgtagctctatatagcatacagtgggatgtcttattattatccctgcattaaagattttaatctggatcgtatgtggttgcctagttgcggagaggtgtgaatcttgcatgtccttcagactgacaattcttgagggtagggcaccgtgccctcctgacttctgctcagcaccttgcagactgctggaccacttctttgagaaggaaactggcacaagcatcccccctagagtgcaagactgcccgtgggcaggaaaggatcccatgctctatgtacttaagcagacctgccagacctaccactctagaaagagacattcatccgtggattgtctttcattcattcaacaaatttaacaaactccagctctgtaccaggcattgttccaggaaagtgaatctagggaaggaggctaccaaagtgaaggaccctgattccatgaattttacattcttaggggaggagacaaacaaagaaggacatcaataaatagaacaattggccgggtatggtggctcatgcctgtaatcccagcactttgggaggccaaggaagaaggatagcttgaggccaggagtttgaaaccagtctggccaaccccagagtaagacccatctcaaattttaaaaatttgaataaaacaaaatagaataatttcaaggaaatcaaatgatgtcatagttcaggagtggggtggagagaggagccccactctaggtcatctgatctgctacattggagctgatcaaaatgatatgaagaaggagtcatccaggcaaagattaggggcgagatgagagtagggagagccattccagcagaagacacatatgccaaggtaagcgagggttcgtcaagttcagggaacagaaggaaagtcagaacagctgaagtttaaggagcaagagagagtggtgagacatgagttaggacaggaagcaaaggccacatcacacaatgaatgccctgtagtcaggatagggagtctgtatctaattcctaggtcaactgtattgcaaacaactcctctgctaaatgtgccaccagtgtctcccaatagggaacctgggagaaacctggaatttgggggattttgtgtaagataaccctgttcttccctctggaattctgatctgtgccaataggtaagcctacattgactaacatagaagggctgtcatacatagaggggttgctgctgaactgaaggaagcagctttatttctggaataaaaaggagtctttcaggctttcccataacacttgctaggttatgacttgaaagatgcagccagcatctttcgtttgctatatcatttagtcaactggtactctaacttcaaatattgtggctagaacttccatgttttcctgggaatttcagaccttgtcccagtttaccacccagagccaagtttcccactatcaagtccacaatgccagaggaaagaacacataaatgcatggagaaatgtatttcttgattctcgttgcagctgatttaggacagcccaatatactgtacattaattaggaccacacaatgatcattgctcttgaactcagccctgctttctagatcattagcagggctggccaaaaggaggccctgctgagattcagacccttattgttatgcaaggaaacagcaaagacccaagctggctttacctggtgctctgtcaacatgcaggtgagcatctgactccacgcttccaaacagggtcattagcaattatggattgtctggggctaggtccagctaatctcacacagaaagcaagcctgattcccactaaagccagagggaaatcctactggaccagagaccatggggttgggtctctgaggagctgataaacttaagcacaaggaaacagctttattttgcaagtcccaactgtgactgggcccctggccttctctgtgcctctgaaactattttcttcagatcccttttttttcatgaagcatgggcctccctgagccacctggtggatattttttattctgaccactgagcatctgttcttcctttactggtaatagtgaattccccctgagagccctcattttcctctctctcagtcaagccaattggcccatagtgccagtaattaattcgggggtggaacatttcctaatctgatctaatcagagtggctttctggatttatgaagaaagggactaggaaaagacagcttcttttactgttagacttgaacttggatggatgttctaccagaatttctggcagccacccaaccactatataccatcctaagaagaaagctatcagacccaaagtttaagctgtaagatcgagagttaccaagttctgatatccatgttgaacaccttgttcaagccacacctgaagacaaattctcttgttgtcaattccatgtcccaattaattacctcattttgcttaagccaatttgattagcttttctgtcacttgcaatcaaagattactgatgccactttggctaggaaaaaaataatgtaacatgtttaactcatcttcctgaacttgaatcagaataattcaaactacagggtagtgcatctctcttcatcatccttcccttttcttaccattcttctctttttcttcatcattcttccctttttcctgggacacccacctctcttcacaaatctcacttttccctgcatgagctcttcatctttcctcattgttttttgtttttctctaatatgtgctgagattggtttcttctcaaagactctgacagccacaacagccaagaccaagacttaagacatgacaagttgccaccaataataatcgcttatcattaagctgttccagcaaagagaaaaagcaaaccagtcccgttcattaagttttcgtctccggctatcatacatagaggagctgctgctgaactgaaggaagcagctttatttctgcaataaaaaggagtgtcttgggctttcccataacacttgctaggggcaggccctggtggtaaacattatcgtcgaaatgtccatttcaaaaatatcccagtgttctcaaagaaatgtctccaaacagctctgaatgctcaagttccagaagaaattgcttcttctccctttgggagtctgtatgttcctgttatcaaaggcacagacactggtaccaaatagagggttcaaatttcagctctttctcttactggtgtctgggccttggacaaaatccttactagctctgaggctccattttctcatttttttttttaaatggagggaattttattccctaccttaaagaggttgttgtgattgggataatgcatgtattactctgagcacataccgagagctccattaatgagagctgtgattatggtggctgttgtaatcaagaaagaatcaaccacaatgacagcaacaaaacccaaaacactacaacccacaaacacagcactaatgcaaatacaaacagctcccctgtggcttttttccacgtcttctaaatgacacaactttgcagcaccatggcaaaggagctcttatcgcgtgccaagcactgaggtgaaagcaggttgacaacccatcccaatgttaaacctgaatgttccgctttgcaggaaccctttcagtcctggacaaatcaggacaatcagtcgatcacacagagatcttcaagtgcatttatttaatcctcacactaatgtttcagggaatatttctattcccattctacagttaaggaagttggggcttagagagaggcagttctcaaactccaatgagcataagaatcaccttggatcttgttaaaacacagcgggtgggggctggggcattgcaagcaagctcccgagtggcatcagttgctgctagtccatggaccaagctttcagtagcaaagttctagaggtcaagtcacatggcatgcccaatatcatgctgcaagcatctctcagagtgatggttctgacccaggggtcctggtgccaggtgacctctgtccatcccagggaggactaggcaatgacataagacagtgtctgatgtctaacattctcaccaccgtgtgtttccttcaggtatatcacaggtatgtcatgcctgtcagtccccatcgtcttatccagcaaaacactttcagttatgagtcagaacatactgcatgggagtaaaggaagaggggccaccctggggtgaaccgcctcactcctgggagagaactgaagccatccaggaacgagaagagcacagagagagaaggaagcaccggtcagtcctatggtgcccatggccatctgccaagcaaagaaaatgaccccagggtatgcatagccacccttctctgcatgccagcgctgcagctcacaaatgtacgcaagtggctgggtctccctgagcctccatttttttcatctataaaatggacctggcagttttctaattacctggaggggagctggggtatctgtaacagggtaatgagcaagagctccatgaactgaaaggtaggggactaatgtgggagctcactgaggaaataggaaacagctgccgcctcctctctcccctccacctccacggtgctcccagaacacactgtccaggtctctattgtcaatcgtcaccaggtattttaggtgtctatttaaatagctgtctccatgcaaccagattaatgctaattcatctgtacagtaatagcacacagcccagctcccagtacatggggagctgagaacacattcagtgaaggtataagtaagcaggtgaatggatggacagacgaatgcatggatggatggacggacggatgaatagattggatggatagatggatgaatggatggacagatggatggatggatggtcaaataggacaaatggatggacaggtggatggatgggtgggtggatgaatggatgggtgggcagatgaatggacagatgagtggatagatggatagggtagatggatggatgacggaagagaaaaatgaacagatggatggatggttgggaggatgaatgaatgaatgaatggatggatgaatggatagacggacagatggatggatgggtagacgggtgggtggatggatgaatggagagatgggataaacagatggacagatggatggacagatggatggatggacagataaatggatgggtggttggatggatggacggacagataaatggatggatgggtgggtgggtggatggatggatggatggacagatgaacagatggacggatgggtggatgtgacatgagttgtgggtataagagattgaagaaataaacgaacatccagtgagaaaggcagtggctgagttagtagcacagtgatgggttagagagggcagggtataagtgagagctggatgaacagggggtgtgaaatgagggggctcagaggtagaactgagtgtctgcagtgtgagaatccattgctacccaaactctcacaatctgaaggcaggaaagtaataaacaattctgaggagggttgggctggcattcttcactgtctgaacccttgttacttgctctctaggattcaggaaccaaacagattcaggcaaagtggattccttctctatcaaaacccaggaaaggaattgattccaaaaagagcccatgtccttgctgctgtcagagatgactgagggctcttgtgagcacagggacagactgtttccctcccctaatctctagcccactcccaagcccctttatgtgttctcctctcccagctacatatcctcacctaaagcttttcctaggtatctttagtcttgcaggtggtgtgagaggatccctagggagcccttggacctcatggttacttgaggccctagccaaggtagaaaaaagaaactaccaagggtctaggagggaggaggtcaccacccatcagatgtgggtacctggagacccacatcttattgctccttctaggtatccaaagctcccaggaagctttgcaagcatcattttcacccctctcactttgcagagccctacaacttgaataggctacaatgacagccttctctaatgaggctactaagcagatagcaaacaggacagctataattgctttgcaggagcagagtcccagccaaatcatgggagatggcttagtgcagtggaaggcgcaaggattttggaataagacacatctaggtccaaacctcagttcttccacaggctacccgtgttgccttgagaaactggctcaaccccttaagcctccgtgtcctaggctgtaaaacaggaaaagcaatttccaccaacttcatagatcagatgagctcatgtacagtagctgtttactgattatttattgcattccgatcatttcttccacattatctcattcagtctttaacgaaaccccatgaagaaggtagtattaatgtctaatgtcaaaactaattaatttaaattttactggattccaaaacccttgctcttcaccactgacaacgtgcacctccctccttatcggtgcttaacctgtgagctccctttcctttacctggtcattctcccatatattcagataccatctgaagatcaacccttccccagcacagtgcttcctccatcaccagcttcttcctctggaagcaatgcatccacagcagaagaatgcaccctgaactaatgccaggagatttagcaacctaatctgcactgttttcctggagcataatattctgctcgcaaatcactccccccactgaagctaacacaatacagagcatcctttaacttatgtaaataagcatcttatgggcatccgatttattcacctctcattgctttggagaccagcagaccaaatacagaatatcatctgcccctttaacagagcaacgctaaattctcatgggtgcatttgtgtttgtgtttgtgtatgtgcgcacaggcgtgcatgtcaaaaagctaatatctgtttgttctcttcagcaagtactaagctgggcagcctgtccaagacccacttgcagctcaaaagaagaggatgaactaatatgaccagagctcaccattacaattaaactctgagcacaaatggaattaggagcataaacaaggggtggaaaagggagagattttaacagaaaaaaatgatggtttgtttttttctccgaagtgacatagaaaaagaaattgaatgtcagcctctgaaaagtgtccaaattactatttgaaaggagaaaaacacaatcaaataaggtccatttgtgttcatgctgagccccagggcttcctggctcccatcacactcagagctggttgcaggcgagagcccaagtcagcccatgtgttcttcaacctcaggtaagtttgtcttctccagtgttgatgaacacagaaggcactccttcctcagggctcagaggacagagaagccctgacactcactgcccagtgacctcccagcccccaacgataccgctcacccttgggtatttcatatttgctgcaaactttgtagcaaccacgagaaataaatagaaggctctccttcacactttgtacctgagaaaattaaggctggaagtgtggagggttcactggcctccaagcctcacccagaaagaaagtcatggagccacagagctcaacccaccctcagcatgctccagtagtgagagttgtggccaaagaaagctcagggcaccaagggaatgcagaggaaggggacccacccaacccagcaagagagggtgaaagggttcccagtgacccctgaggtccttgtagatggagggcaacttggcacaggctggaaaggtctggagacagagtacagagaggacagtgtacaaagacagtgtgcagagacacacagaatgaagaacatggcacccactgggaatgtgagcagcttagtgctgaagaaacacatgcaaaaaaaaagaaaaaagagccagagaagtgtgtggctaggggaagaggcagggcccgagggtaggtccatgcctctctggctcacaatgagaaatacctttgaatctggttccatagttatctgtcacctttacgttccatataactcatatgatttacttacaatgcttattattaatattttctgtctgttcaatgtcctatttgatagaatataagctccatgaagtcaggtatattctgtttgttcattgatcccaagtacacgtgacagagcctgccacagagaggaactcaatgcttatatctgtgggattggattaaagacattcaaataattattgaatgaaagagagaaagtcaggcaacaagaaagtgagagaaaaagggaaaaaggaagaaaaagagggaggaagaaagagcatggaaaggaggaaggatggagagacacagacagggagtgaaaaaaagagacaaggagttaatgctttctggggttgacgagaagaatccatgaaagaattttttagcagcggtgtgacatgagcaagtttttatcttcgggaaggaccacttgagcttgagtatgaggaagggcttggaggagggaatgaatgaaggcagaaaagcaggcccagagaaatctcactaaagcaactccagaaaagagagaaagatctgaactaggattgctgcaatacagatacacaaaagagaggttcaagagatgtttaggaggtacattcaactggtcttggcaactcatggatcggattggcagggagattggggagtgaaagaggattgccaagtgaatggtgatgtcacttacaaaagtggagaacaggttagggaccctgctttcttcctcacaattgtagctccagcacctagccttgtacctgacatacagtagccactctgtaaatgttttttgaatgaatgagtgagcaagggtggaagtgagtataggtagggggacagagaaatgcatatggaattcaggtttaggttagctgcttttgaaacctccctgcagggagtccaccaagaaggtggataggcaggtctgaagatgagaaaggggtcagggctgaggcttgagatttagaagttgtctatctgctgggggcggtagttgttgacagctgtgcatggcatcccctaacaaaagaaggagagtgtgtgtggaaaagaggcagagaaggaatgtaggagaggtacgaggagaaagccggggaatgcgataacttagaagccacgggagtagagagcttgaagacgaaggcaggggtgaaaggtgtctagtgtccaggaagacaaaggctgaaaggtactgctgtgtggtgcagtgagatgttcacctgggactttaaggcaagtggagtaggtagaagcacaacctcagagtggtccagaggagtgaaggaggcagaagtagtaaaggggacagtggaggacgttccaacactttccaactgccccatgcttcttctcaaacacaacagtattttagaggtatagagaagaatttctctgaatactgggattcaaactggggtcagggggctcctcctcctgctttcttttttccccattccccaatgtcctctaagtcaatccttctgtcctagacagagaaacttgtgccagaaaacacaggatatcctaaaataactccctacatgctaaaggaaaacgaagtgaacatttttcctttttaattccaaaatcatgcttgcgatataccttcaatgttgaagaacaagattccttagtttttcaccccggacatcaccttttccttacagagaaaacgtaaaatctaagtgtgtcttgttccccagagaacaaaaaggaagtgaaaattagatgtgcacatggtcggcagattgagatagacagattcctagacactctctggagttaagacggctgctctttccagctcacacacattgcatcatcttgctgttgatgtctcctcaaggatttgttccaacactctgatttgtaaaggacccagaacagagcttattaaaaactcaagacactatatctgatgggggagcatcaaggggccattaaacactcacctcattaatagcctgcagaatgagtccttttctaaagctcacacaagatggtgattagacagtcctggcatacaaacccatctctccatttttcaatcccttgccgagcaaaattttcaggccacaaattagaggtacccctggcttaaaacaaaacaaaacaaaaaggttgggattttaatgagccttctgcctctaaataaatctctctacccggcactcaagtcctctccagacttaaatgaaatgcatcgacaaagcaagtcatgcagtgggatgaatccagaattcaatatgagtcaaagtcctcctttctccaggccagcgtcctttatgttcattatgttgagtggtaagtttgtaccaagtggcgttaggcttactccacagttattatgcacatagtgactgtgatgatgtggtttccatcacctgggatcagactgtacttattctacagactgtctgaagttggggatgagtttggtgtcatccccatgggcagtcaataaatccttgcagccatttgcctgagtcaaggcgagggtttcactctctcaacagcctgagcttaccactactgcagtgctgaccattcagtgtcaaatgtcactgaggacaaataccacaaatcaccacatggcctgtggataccaatgggatatgtagtcttgtcacagatcacagcctccccaccttgctttctcctctctggatgcaatgacctctcggccaccttgtgtccaccacagagactttgcttgtcttgttccaggttccttgaactgttcttaccttctctgtccaactcctattcttccttcattcatttctagatcatcatttcctaagggatgtcttccataccctcacggattaggcaaatttccgctcttccatgctctttcttgtattaggttagtgcaaaagtaaattactgttactgcccctacctttaatggcaaaaacagcaattacttttgcaccaacctaatattttcatagtacttaatgtggctgttaatcaacattgatttatagactgctttcatgaatgtatgtgtccaccatttaaacaaattgtccagaaaggcaggggctatgtgtgctgttttattttgtcttactaatcactatatctccagcactgtagaagcctaattccatttttggttttgttttggtttactagtttactggcttgttttgaatgaggttaggcagcttgcctaagtgcatcaaggcgaatgagctccctgtgtcacacagcatcgagtaagtcatttctttcaaactctctctcaccgccagcttcaacaaaccaggaaacccatcaggctgtatcacctttgggcagaaatccccaggggcttgggcatcacgctgacaaagtctctgccaggtgttaggtgctggttcctatcattggttccatcaccccttaaagcggcttgcaacatccttgtaaagttctgttgttcggactcatgatcaagacacaaaacaattctcaggggcttgaatcagcccctcctagctgctactgggtgaacactgtgatttgtgacaggtaatttaaatgcaacaagtagactttcttcaaatgtagctgccactgaagtgagatgtttggaaagaatccactgtcctgtgggctttcttgtgttttctgtttttgtttctgttattttcatgttttaacttaaaaaattttaaacctctacctataagccacataatacccatacttaaaaagcaaaggtgaataaaaattcagattctcaggggatctatgcaagtcctggtttatcacgtatgagccgtgtgtctcaggaaactcacttcatttcactgatctttagagcttcagtctcttcacaggaatgacaaatagtatgaatcttaccaacttctagaactgcacagtgagccagatgtcaattatcacttaactgtgtctttaattaattcattcatttaacctattatttattcatctctggaccaggtacagtgctgaaggctgagaatccagtagtgaacaaaaacagccatgaaacctgcgctcaaagagcttatgatccagatggaaaagacaaatattaattaaacaactacacacgtgtaaaattgccattgaaattcacattttgtaagaaaagcttatggtgcattaagaatgcacaatgggggaaacagaacaatttagatggttgaagacttctccaaacaggagatgctggagtaggggttatctaggcaaagaggagaggacagaatgcctcttgcaaagaaggtgcttcatatgcaaaggtacccagataggaggcaagtgtgagggtctttaagatagccattggggtgagggtgaaagagactggttctctgctaataaaatgtatttgtattcctttgtacctaaagaagaggctattaccttcctctgacctctcagttgcccaagaatcttttcacagtttctatctaatccctttcaataattccctggctgctaatcagagaaaaggtgttaattcccttattagcatacctctgcctctctgtgatcacaaaatgctcctaacttcctccaccctgggaatgcccttggctttcactctggccctgtgtgctatctccctagggcttgttctcagccagggggaccagcctggcactcatctggtgccagcccctaattttactcagggaagattatttaagggagctgcccatgttcaggacacacacagtggatataggattgagctccaaacacagggctgctctcactgtgggacacagccactccctatctcatggaccacccaaggaagaacaagctctttcacttctgcgagcactcttcagtatttgggtcctgatactgtggtacctttaataaacttttttcatgccttcccatgtgaaaccccaattcactttgaaagacattaccagtaacaatatcacaatccacagttgttctctgcatgcactgggtggccagagtagtggaaataaagcaaatataaaacctaagaggcagcttctaataggaagggagattacccaaatgatgtcatcgcatcataattagcaatagggccagaattaccaaccacagcaaagcacgtcaaaatggggctatctcaactcttccttaattgggaaatttaacaaccgaaagatgcccctcgatgactctgaagggcttggtttctcgcatttcctggacctctttgaacctcacctgagaactcttctatagacttgggcaggtgaacatcacctgggcctctgcctgttggttttcagcagggttttcacattggttgcccccatgagcaacacttggccactgatatgaagggcttccccaaagaacacggttggcttgttttccatgttgattgtgcatgcttctctagtctttcctctcagttataccaggaaagagagatagtgataaactgctttagaatcacagctctgctatctccaagctgggtgactatgaggaagttgcttagcttctctgtgcctgccttcttcctccataaatgaagataactataacttctgcataagcgactgtgaggattaaaattggcaattgatgtaaaagcatctggcatgcaattaacttccaatacatttagttgttatcataattgccattaataacatccagcctgacctgaacttactactaaatccatcctccttgaatgctgacttgccacaaagccatggctccctcttgctgatgtgggcaatgttggtcttctgagatcatctttcttggcaaaccagaccgtgaattgccaaatttactactcctcatgcccatcaatgaccacacagacacatgcacacacacacacaggttcaaccccacttccatatctttagcaatggtctcctggggctctgttcccacggattttatctggcacagtatgtctgaggtgtgacccagaaatccgtatttttaagtagattctgaagcaaatagtctgcaaattggtactaggacagaccccatgggatggaagcactttgccaaagtgaactatcaggaattacagagagctggggaaagaatgcttgctgtgtattaggtttcagttgcatatattcgtttgcataccagattgcaagcagagggcagaaattagaacctgaatagcttcataccttacctccacctgtctccaagccacatatagtatgtgctaaataaacactaaagcataaactgccttaacagactagaaaatcgatacaagcatgggcttgttcactgatacatcccttgtgctggctgtacagaaggtgccagtgaatatttgttagataaatgaattaatgaataaatacagaggagttggtagggaaaaggcacaaaatgagcagaattggtgctaatttatgttgaatcagacaaatgttcagcttatgccccaaatttttacaaccatctcccttttaagtcactgaacaactgctaggagcctctgagccatgctaccccagaataccccagaatactcattcctattcaaatatttggttttcagtgttacaaggacaagtattcatttggaccagagaaataggctggatttgcactcatctgtcacagtgccctgaaatcagcctcaaatgattcacagccctcttgaaaacatctccaatctcctaagagataaaaagcctcactcattttcccacccctgacccaccaaccagcttccatccctaaacctagagcgaaattatgatgttctgtctcctcctcctatttctattcctcatgccctgcatgtctccccataggagctcataataggcttgtaggttccacctgattctgaaaatcaagttatggcaccgaggttttggaatcacttcaatctatttgcagagtgagcctggttagtatttaaatatgccacccaagctaccgatgtgcaacgtatcaactcttcacctgggatgatttattccaggagtcgccgttctgacttagtacacaggctttccactgtgctaaagcaaggagcccaaagaactagagggcttgccaatggttttcttgtggttttattcgtgtactaattaaaaacattggccaggcatggcggctcacgcctgtaatcctaacactttgggaggctgaggtgggtatatcacctgaggtcaggagttcgagaccagcctggccaacatggtgaaaccccatctctactaaaaatacaaaaactacctgggcgtggtggcgcatgcctgtgatcccagctactcagaggatgaagcaacagaatcgcttgaacccgggaggcagaggttgcattgagccaaaatcgggccactgcactccagcctcggtgacagagcgagatttcatctcaaaaaaacaaacaaaaaccatagcacataccagcaaacctagaaactcactgaaaccacataattgagcaatattaaaggcagagatgatgtggcttccaggttgacacccaactatctggcccaggtaacagatagtagaacctagtagtaaaaaaggaaaaaaatgagctttgcatataggaggggctcaatcaacaatgtcccatagtaggtaattcataaatatcagttgaataaatactgaatgaactagattgcagacacagagtttataacaacctaagtagagattacatgaaaaagttggatataattttgcatgtatacttttatcataaccttattaaataaacagataaaaaactatacacagaaaataatgcaaaaagataatacaccccaaaatactaagagcgactgttcttgggttgtagcatatggatgcctttacattttcttgcttctgcttttctgtatttttcaaattttccataattagcctgtttcttttataaatgaaaaattaactggaaaacgaggcagcctaggtaggtagggagagcatatgctgtgaagtcaaccagactatcttttattaattgtatcacttgttcctaacgtgtaatttttcttttttatacactttatttttatttatgtatttatttcagacaaggtctggctctgttacccaggctggagtgcaatggcatgatctcagctccctgcaacctctgcctcctgggctcaaaccatcctcccacctcaacctcccaagtagcagggactacaggtgtgttccaccacacctggataatttttgtatttttggcagagatgaggttttgccaatgtcgtccaggctagtctcaaactcctggactaaagtgatcctcctgcctcagtctcccaaagtgctgggattacaggcatgagccaccgcacccagctgtaattttcttagtctcaatttcctgagttatacacttgagctaataacatttaccattcaagcgagtttgttattgttgttgtcatttacgtgcaatttaatggatgtaaaatactcagcactatagtacttggtatatagcaagcattcaatatatgtatgactttagcacccaaaagactattagaaaagtacagtacttattcacgtactcgtttacttaatggctctttattaagcctcaaccatgtaccaagaactactatctcactgaagctgtggtcccggaggaagacattccaagtctgaatctctggttaccactctgatggaaatacgcagctacaacccaatagaaggtcacatgctccagacagggaactcatctaatgatatgggggtgcaggggtgggggatcactaggagagtgcaggagtaaagaggtttctacacttatcctaacgaatgaaccacaaaagcatcatgctgaagcaaaagaagccagccacaaaacaaaggcatgctatacaagcccatttataacagaacagaatggaaattttataaaagttcaagaacaagcaaaactaatctatgatgattgaattcagaataatggttatcttggggttggtgagaagggagcaaataagaacttcatagggaactagaaatgttctatatctttgcaatgtatctatgtaataaaactgcacttgcacctcttaaatttaaacaaaatttttgagatttttcgtgaaaacggccatactgcccaaggtaatttatagattcaatgccatccccatcaagctaccaatgactttcttcacagaattggaaaaaactactttaaagttcatatggaaccaaaaaagagcccacaatgccaagttaatcctcagccaaaagaacaaagctggaggcatcacgctacctgacttcaaactatgctacaaggctacagtaaccaaaacagcatggtactggtaccaaaacagaacagaacagagccctcagaaataataccacatatctacaactatctggtctttgacaaacctgacaaaaagaagcaatggggaaaggattccctatttaataaatggtgctgggaaaactgcctagccatatgtagaaagctgaaactggatcccttccttacaccttatacaaaaattaatccaagatggattaaagacttatatgttagacctaaaacgataaaaaccctagaagaaaacctaggcaataccattcaggacataggcatggtcaaggacttcatatctaaaacaccaaaagcaatggcaacaaaagccaaaattcacaaatgggatctaattaaactaaagagcttctgcacagcaaaagaaaccaccatcagagtgaacaggcaacctacagaatgggagaaaattttcgcaacctactcatctgacaaagggctaatatccagaatctacaatgaactcaaacaaatttacaagaaaaaaacaaacaaccccatcaaaaagtgggcaaaggatatgaacagacacttctcaaaacaagacatttatgcagccaaaaaacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacatttttacactgttggtgggactgtaaactagttcaaccattgtggaagtcggtgtggaaatcggtagattgctcagggatctagaactagaaataccatttgacccagccatcccattactgagtatatacccaaaggattataaatcatgctgccataaagacacatacacacgtatgtttactgcggcactattcacaatagcaaagacttgaaaccaacccaaatgtccaacaatgatagactggtttaagaaaatgtggcacatatacaccatggaatactatgcagccataaaataggatgagttcatgtcctttgtaggggcatggatgaagctggaaaccatcactctcagcaaactatcgcaaggacaaaaaaccaaacaccacatgttctcactcataggtgggaactgaacaatgagaacacacggacacaggaaagggaacatcacacatcggggactgttgtggggtggggggcggggagggatagcattaggagatatacctaatgctaaatgacgagttaatgggtgcagcacaccaacatggcacatgtatacatatgtaacaaacctgcacattgtgcacatgtaccctaaaacttaaagtataataaaaaaaaattttactctaagttccaggatacatgtgtagcatgtgcaggtttgttacataggtatacacgtgccatggtggttggctgcccctatcaatctgtcatctatattttaagccccgcatgcattaggtatttgtcctaatgctctccctcctcttgccccccacccctgacaggccccagtgtgtgatgttcctctccctatgttcatgtattctcattgttcaacttccacttatgagtgaaaacatgtggtgttaaacaattttttaaaaaatgttctgcatctcgatctgtgtggtcacaattgtatatatgtgtaaaaattcattgagctttacacttaagattcatgcattatactatatgtaagctatgcctccataaagtaccactgaaacataaacaaaaggcttttagataattactacaggtttattaaccttcagcctctgtatatttattgagaatctgctattcaataattcatccattcaacagatatttactatatagctactctgtgccaggtactattctaggcactggagtatagcaatgatggacaaactccctgcctcatggggcttgcattttagagctatgtgccagacatagtgccatgtcctggtggaggagaggaagtgcttgtggtgcaggaatgaaagaactcacagtctagtggacagacagacacaaagtcacaccgcaccatgcagtaagtgctgtgatagggcatgtggtgtcttgatgcacagcaggaaggggccacgtgggttgattgcaaatttggagagggctcccaagaaaacacaacacagcctgaggatgaagcagcagagattgcaggtgactctttggaggaggcaacagcatccttgaaggcatgtgtgcaaaggcactgccgcatggacttgaagggaatcgtcaaatatccaaatggagtttcataccatggagcttacatgaatttacagtacaagtgtggccctggaaccagtgacccaatcctgcatctaccacttgataaatatgggaccttgcacaattactcagccttgaattcttcttcctgaaaatgtgaccactgttagtgcttaattgaggttcttgtgacaatttaatgggatcagccatggtgcgttcattttctattgctgctatgacaaattaccatcaacttggcgggggcttaaataatcctcacttattgtcttatacttctgtggttctgaaatgtgaaatgggtctcgctggactaaaatcaaggtgtcagcaggattgctttcctttccggaggccgtaggggagaatccacttccttgacttttccacctttcagaggctgcccacattcctcggcttatgactccttccttcatcttcaagccagcaccactgcatctctctgactcttccatcttcacatctttctctgtccacatcctggaaaagctcttcacttttgaggattcacaggattaagttggtcccaccttgctaatccaggatcatccgaatctcaaggtactaaaccctgaatctcacaactgcaaagtcccctttacactataagcaacatattcacagcatggacatcttagggaagccattattcttcctatcacacgtgaaattatttagcacaacgtctggcttatagtgtgtgcttaataattgtcaggaactatattactattattaaatgtgattcaagagtatgagaaggaaatgccaaatcctctggaccaataagcatgcaaatataaaccaagttaggtgtaaatcctgggaatactcaggtctcagggaactactccaaatgatgtacaaacctagagtttccatttaggcaaaaggttctaataaagtaagacttcttcactaaatactatcagttgcatactcacacgctggcagaacaaagactgcagggtgtttcagcatctccataccaacagctagaacagattcctctcctaaccctctgtgccgtatcaaccagctggtctagtctgactcacaaatggctacagcctggtggtaaacggaactttgttaaccatttgcaaaaaattccaggcaactggggagatggaacaaaaatgccccccaaagctgcctcaatatcattaaaagttgggcagtgaggaagccaggaaatagaacacaaagcatgttgggctgagctatagaataagagacttttgggatagtgaacaaactctacctcccctattttaagcagaaatcacaaccgattttgattccacttaataatttcctcgacacttgaagagatggcaggctccatgagagcaaggatcctgccaggaagccaacagtccatctctgatgtccagtccatgtctagcacacagctgagacccaataaaataaaatgtgtggaattaaggaataaatgaatggagaggaaatcacccaggatcacaatcaagggtgatatttacattctaaagcaggggttgacaatccatggcttgtggaccaaatcctccccacagcctcttttatatagccccaaaacacagccaagccctttcctgtattgtctgtggctgcctttgtgctatagcagcagaatgtgtggcctcttggtttgccaagcctaaaatattgactatctgggcttttaaataaaacacttgccaattgctgctttacaatactttctggtagcttatcaaaataatcttgggatcttttaaatatgcagcaccttaagcccagaatctgaattttaactagtttcccaaggttcgagaatccttgcacttatagagaattgatctgatttgacaagcacgagggcagggttctcaacttttcttttacttttaagttcaaggatacacatgcagatttgttacacaggtaaacttgtgccatgggggtttgttgtacaggttatttcatcacccaggtattaagcctagtgcctattagttactttcccgactctcttcctcctcccaccctccaccctctgcaaggccccattgtgtgtttttccactctatgtgtccatgtgttctcatcatttagctcccacttttaagtaataatatatgatatttggttatctgttcctgtgttagtttcctaaggataatggcctccagctccatccatgtccctgcacaggacatgatctcatccttttcttatggctgcatagtattctgtggagtatgtgtaccacattttcttgatccactctatcactgatgggcaaatatttaggttgattccatatgtttgctattgtgaacagtcctgcaagaacatacacatgcccgtgtccttataatagaacgatctatattcctttcggtatatacctggaaacgggattgctgggttgaatatttctgtctttaggtcttcgagaaattgccacattgtcttccacaacagctgcactaatctacactcccaccaacagtgtataagcctcgatcagaatcacccaaaaggcttgttaaaacacagactgacaatccctgcccctcactttctgattcagtaggatgcatatgggcctgagaatgtgcatattttggccctatctcaagtgatagtgatgatgctggtccagaaaccacactttgagaaccacagcacaaaggttacccagtgcccttccttgtttaatagtgactcattttccacacttcagccttcagcagtagtgaaacatgagtcactgttaagttctcacgatgaaattctcactattagttcagcactattaagtgactcatgttcgacacttcagtggtagattctgtgttcagcaggtcccacattttgaaatttggggtgaattcttcctgcgactctgtggtaataaagaatatgaattatgcttacaattgcaaagatatggaacaaacctaagtgcccatcagccaatgagtggatcaagaaaatgtggtagatatacaccacggaatactattcagtcataaaaaggaacaaaatgatgtcttgcagcaacttagatgaagctggaagccattattcgaagcgaagtaactcgggaatggaaaaccaaatatcgttatgttctcacttataagtgggagctaagctatgacgatgcaaaggtataagaatgatacaatgggccgggcacagtgactcacgcctgtaatccccgcactttgggaggccaaggcgggtggatcacttgaggtcaggagtttgagaccagcctggctaacgtggcgaaacccgtgtctactaaaaatacaaaaattagccgggcgtgctggcgtgcgcctgtagtctcagctacttggggaggctgaggcagtagaatcgcttgaacctggaaggtggaggtttcagtgagccaagatcgcaccattgcactgcatcctgggcgacagagcgagactccatctcaaaaaaaaaattacataatggactttggggacttaggggtagggaaagtttgggagggggtgagggataaaagactacaatagttagtagtcttaggtgatgggtgcaccaaaatctcagaaatgaccactaaacaacttatccctgtaaccaaaagcacctgtaccccaaaaactattgaaatagaaattaaaaaaattttaaaacagtatgaattattaatgcattaggaggcaaagacagtgaaatgtcagaaagaaagacacttatgactgcggttggaattcatacagtgtttcattatttccaaaggtagtccccatctattatctcacgtaaacctccagacaacccagtgggtaggcgttattattgcaacgtgattcttactcccattttgcaggaaaaaaggaggaggctgaaagaggttgaaaatagatacaagttaatctccccgacactccccctatccattcaatgacaatctctctaggctttgtattgcttccttccttcttctctcccctgcatctatcatttctttgcctctattgacttgtatgtatgtatgtatgtatgtatgtatgtatgtatgtatgtatacatgtacgtatgtatgtatttagagatggagtttcgctcttattacccaggctggagtgcaatggtacgatcttggctcactgcaacttccgcctcccgggttcaagcaattctcctgcctcagcctcccaagtagctggaattacaggcatgcgccaccacacctggctaattttgtatttttagtagatttggggtttcaccatgttggccaggatggtctcgaactcctgacctcaggtgatccacccacctcggcctcccaaagtgctggaattacaggcatgagccaccatacctggtcgtatttatttttttgacagagttttgctcttgttacccaggcgggagtgcggtggcgtgatctcggctcactgcaacccctgactcccgggttcaagagagtctcctgcttcagtctcccaagtagctgggattataggtgggcaccaccacacccagctaattttgtaattttagtagagatggggtttctccatgttggtcaggctggtctcaaactcccaacctcaggtgatccgcccgcctcagccttccaaagtgctggtaattacaggtgtgagccactgcgccctgccctcaaaccacatatattaaagtaaaaagaaaaagttgaaattaatattaataatgtatcttattcaactcactatattatcattttaatgtgcaatcaatataaaaattattattaatgagatatttcacattcttttttttcacagcaagtctgaaattcagagtgaatttaacacatatagcacatttcaggtcacactagccacacttcaaatgctcagtagacacagggagtcaatggccatcctgttgcacaaaacaggtttctgtggtcaaggtgatctcctcgtcccatggtccttttttgaacttggtgttaccgaatctttcctctactgacatcacctcccttttctccttgacacactctcctccattgctgcctgaaacatctttttctccttgtccttctcttatatccccctatcattccttcttagatgcacactttcttcactcgccacttaatgagttagtgttccccaaggctctgtgttgcatccattgttcctcactgggtacatcatttacttggacattttatccatccttcatggttttaaatatatgccaatgccttccaaatccagatcattccactgggctttgatatttaaagaactggatgttcatggtgccccataagccagttaagctcagcagactctaaaactgaccttgtcatccaccacccaaacttactcagtgatacctcaatccacagccatccagataccctagaccagtggttctcaacatgcaatgactgtgctccaccaggggatatttcgctatgcctggagatgcatttagctgtcacagctaggaggcagggtatgactggcacccagtgggtaaagaccagggttgctgctaaacatcctacaatgcacaggaaagctccctattcacaaataattatctagcccaaaatgtcaagaattccactgctgaacaactctgccttaaagccttagctgcatcagcagctcacaggagactcacaggcacgcctactcccgcacgccatcttagacctactgaattagaattctctgaagtggggcctggggttggtgttttaacacactctccgtgtgaatcttatacacactacagttcaagaatcacactctaggtagagccaaccttgacgtcaaagaaatctcgagttcttgttctgcaccaagcattgggatccctaatacagaaaaaagcagctcaaattcaatgtttgagtaagcacttgacttcagccttcaggatacaacctgctaggcctccaggtgaataatttaacttgttttctctttattagcactattccagaaaaaaattgacctgtaaggttcatagtccaaagcaacaagtctttaatgtacaatccttttcttagccctggagcttggagattatttcttcaagtttaaagctaggaaatagagcagtgttttggtgcattgcccactagagagactggagtagagaccaatgcaggaaaatcctgaaaccttttcatcttattaagctcagtttatattttaaaacatatgaaagaaagtgcttttgagatatggagataaagatacgatagatctgctaaggaaaagaggccttgaggattgtttagattcacttggctgctggagggccctagaaagaagtaaattagaggggaaataaatctggaatcgagttcttgctctgccttaactgactgtgaatttaaaaaaaatcattttggttcaagaaatatgtattaaggatctctgatgagctagacacaaagttaggtactgaagataaaataaataaagcaggcagagtcccctaccttaagaaaattacaggctggtaaactctcaacaggagaaatattggatatatcaaatatagttccttcccctgagaaacgcagactggttggtgagacagacaaatagattttatgatttcagaacaatgtagtaaatgttaaagtattacagaatgctatggaataatggagagatgagaggcttattcaccctgggaaataaaggaagcctttctggagaagacaaagagttgtgtagatagtcatttgagaggcaagactggggggaaggggagaggctagaaggctatttcaggaattctataaagagatgatcaaggcatgaacaaaggctatgggtgacaaataagagcagacagtatgaggtggggtgaattaaggatgcccacactgttttctgttattcttcccattgacaggtggattgctttattctcctcttgaatctgaccagcacagtgactatgtgaccaatagaaaagcctaattttcagtaaaacagaagcttccacttcttccctgatataacaatttcccttgggtatgtcaactcaaaactcaaccaccatgctttgtgaaatccaagccacataaaaaggttacattaggcagtgagctacgcccccaagccaatagccagctccatccacttagccatgtcatgagccatctcatacatttcagcccaactgtgctctcagggaactgtagcctcagctgttattacatgcagcagaaaaaccacctagtagagcccagtcaacccacagaactgtgactgacaataaaatgattcttgtttctagctcctgtatcttgtagcaagaatatataagaatgtaaaactgccaatgtcgggtaagaaaatgagatggctgaagatgatgacatgtcagtctaactttaccataaaaattatctgatctagtttatctgaaaaatagttccagcagtgtagaagtttaagaaaacagcagaagatagccagagttctgcttctggtatggtaggaaatctcttaacagattccctcccacacccaaacaggtaaaaaattaaagctagaaggaaaaaaaaaatatacctgaaggctctgtagagtaaaaatagccagtagatttcacagggacattgaaacatggaagaagggctcatcatagagttctacatttttgccacctaggtctgacagcatgctgctgtcccaaaatggcaccgggtggctcaacatctagtggaagagccaacctctttctggcctgaggaggtggaagttagagacctggaagtccacggccagcagaatataaaaaccccagaaagaggagacttagagaagggaattcttggcatgtatatgtaaactctgcccaagcctctggccagtccttgaacaaagggtgagtagacaaggctcaaagtagtttgcatttaaacccaacaggactgagaactaagcctccacctgagagacagatatggaaatgtaagtataaccaggttagttacctgctaagacacaaatatgaatactctttaaggaaatataacccacaatatagcattcacaaagtgctagtacaattcaaaattactttacatataagaagtagggaaatctgacccattctcaagcaaaaaagacttactttacatataagaaatagggaaatctgacccattctcaaggaaagaagacaatcaacagaggccaatcccaatatgatccaggtgttaaagcagctattctaacaatacacttaatgaggtaaaggaaaatatgctcatcacaaagaaaaaggtaggaagcctcagaagaggaaaataaaaaaaagaacatttagaaatgaaaaacaaaatatctgaaataaagaatttactggatagaactaacatgagaatgaagatgacataggcaggagtcagagagcttgaagatagatcaatagaaatgacttaagcagaggggcttttataaattgacagagtgagatctaacatacatgtgattaaagtgtaaccacccaagatcaccttgccactgtctagacagagccgatttatcaagacaggggaattgcaatagagaaagagtaattcacacacagccagctgtgcaggagaccagagttttattatgactcaaaatcagtttccccaagaatacagggatcagagtttttaaggataatttggtgggtagagggccagtgattcaggagttctgattggctgtctggagatgaaatcacagggcgttaaaattgtcctcctgctgtgagtccgttcctgggtgggggccacaaggccagatgagccagtttatcaatctgggtggtgctaactgatccatcagatgaagggtctgcaaaatatctcaagtaccgatcttaggttttacaatagtgatgttatccccaggagcaatttggggaggtttagagtcttgcagccttcaactgcatgactcctaaaccataatttctcatcctctggctttaggcaatccccaggcaggaagggtgtttgttttgggaaagggctaatatctctttgtttcaaagttaaactataaactaagtttctctgaaggttattttggcctacacctccgcccaggaaaaacaaggacaacttggaggttagaagcaagatgaagtcacttaagtcagatctctttcactgccatgatttctcagttataatttttgcaaaggtggtttcaaaagttcctacaagaaagagaatggagaaggggaaaaaatattgaagaataatggccaaaaagaaatttggtgaaagacataaacttacaaattcaagaaactcaaagaaccccaaataggacaaatgtggagaaaaccatgctaggcacatcacagtcaaactgatgaaaatcaaaagaaagaaaatctcaaaattagcaagagaaaaatagcacattatatatagagaacaatgattcaaatttttcacagacttaagattagaaactacagagtccagaagacagtggaataatgtctttataagtgctggggggaaaaaaaacaaattctataattagtgaaaatgcccttcaagaatgaaaaagaattaaagacttttcagataaaataaaactaagagaattcatttccagcagaccagcccttcaagaaatgctaaaggaagttattcaagctgatacaagagaaaataataccagaagaaaactctaattccttcaggaattaatgaagagcattagaagcataaatatctggataagcataaaagactcttcttttaattaaaaaaatacatatgcatgtgactatttaaagcacaaatccttacattgcctcttagggtattaatgtacagatgcaatgcatataacactatagcatacaggatggtgagggtggaagaagagagacaggccctctcacattgttttatacggttttatactcagaaaaagaaagagaagcgaaactaaaggcagttagcctggtgcctaggaaccagacccaaaaccaaggaaccagacccgaaatcaggcctgggcctgcctgacctaagcctggtagttaaagatcgacccctgacctaaccggttatgttatctatagattccagacattgtatggaaaagcactgtgaaaatccctgtcctgttctgtttcgttctgattaccggtgcatgcagcccccagtcacatactccctgcttgctcaatcgatcacgaccctctcacgtggacccccttagagttgtgagcccttaaaagggacaggaattgctcagtcggggagctcaactcttgagacaggagtcttgccgatgctcgcggccgaataaacctcttccttctttaactccgtgtctgaggagttttgtctgcggctcgtcctgctacaaggggaatgagtaggccctatactgaaaagtttctacattgtatgtgaagcaatgcaataccaaccctaagtagcctgtgaaaagctaaagatgtttcatgtgatccctagagcaatcactttaaaaatgcaaatagagataatttcacttcttcctttccaatttggaagccttttatttctttttctggcctaattgctctggctaggacttccagtactatgctgaatagaagtggtgagattgaacatctttgtcttgttcctgatcatagaggaaaagctctcaattttcaccactgagtatggtgtttgttgtgggcttgttgtatttgacctttattggatatacttctatcatgaaaacactcagaaaactggttatagaaggaaatagtttaaattttataggaattaaagtattaaaatttttaaataattttctgcatctattaagataattctgcatctattgagatgagaggtatagattaaaagccaataaataagttaaaacaaagtgtgtaaatactctaaaaatccataaaaaggcagatataatgggcaaaatggatcccccaaagatgtccacacctttaaccctggaacctctgaatgtgttatgttacatgaaaaaagtgattatggacctaaaaacggagagattatcctggtttattccatggatcctactcacaagtcccctgaaaaacagagaactttctccagctggagtcagagaagtagcagagaagaagtcagagagactcaaagtgtcagaagatcttcattcaccattgctggaggagctacatggaaagcatgagaaagaagtctctaggagcaaagaccagcctgccatccacagactgcaaataaatgggaacctcagttccacaactcttcggtttgtgaatcattcgtcacagcagcaacagaaaactaacagagcaggaaagggagaagagagacatgaaaaacagaggggaaatacagaaacaacaataaacatgccaaacccaaacacatcgataactgcattaaatgactgtggactaaaagttgaagactctcagaatggatcaaacaaaaacaagaccaactattctctacctacaagagatgtactttcaatgtaaagacgcagacagattcaaagtaaattaatggaaaaagatacaacacacaaccagaaaatgttagaagaatggaccatctttattagcatcagataaaacagacttcaagacagtattcccggaggggcatttcataatgagaaaagggtcaattcatcagaaagatataataaccataaatgtgtatgaacttaataacagaacccccaaaaatacagaatggaactaaaaggaaaaatagacaactccacaatcacagtttctcttcaacttccatcacagatatttcccattatttattattagtctataaaccaactttttaaaatgtaattaagctattctaaaggaaattttatagcttacataaatggggagcctcgtgtcacttacataaataatcaccttgaacataaagcaaaccatatcattaaatcctggccagacaccatggcatgactactatgtgagtctgtgttctttaactggggctgtgtaccacctaaagccatctcatttacctgaggtgatatgcagccccatattctgggaaacacttatgtaacctaactctctcacatgtccaaaggaggacaggacactaactggtctcctgtaaccaaacaagttgctgccagatcccggtgttctgatcctttgttgaacgttccttcctctgttctgtgagtcttttattagcattaagagtggaacccaagcctcctctttaaagttggcgtttgaaacccaacagaaaactgcaagctccaggaccctgaaccaactgagactcagaagtgctggtggcattcagcatccaagaacacttagagccaagtttgtgctgtctttttaacacgactaataccatcagtggaattaatagaaaaatgaaagccggcactctaattccagtaatgaaatcacaggcgcacagctcccacctttaggagcctcacaaatgatgcatgtcctctgaagccattcagctggcgtcacttgtagatatatccctccgagggaagccactatccatccggtggccagcctgacaccacatcgcgtgacaaatgacatctgagaaccaagtcgtaccaggcaaaggctgccacatgagtggaatacaaaatagttttctgcatgtgttcagttcactgctgtaaataagattcactggagacctgaaacaggagggcccaaaataattttggttctgattccgacaacaaagaaagagttgactctccaccttctctaactgatcatagtgattaatctctcaccagccagtttattacatagtcctgctcaatctaaagctggcatgcaagacaccattttcaaaaattaaacaagccaggtgtggggacacatgcctgtaatcccagctacttgggaggctgaggcaggaggatcgcttgagcccaggaatccaaggctgcagtgagccatgactgtgtcactgcactccagcctgggcaacagagcaatactcttggagcaagggaggaaggggggagggagggaggactgaccggagtttgaatcctgggtttatcatttgctaattgagtgattttaggaagttatttaagccttgaagtctccatttcctaatctgtaaaactgaaaaaatagtattacctcaccctaaatgagataattataattaaagttaatttcattgcatgccatctgccagatactatgttaagccctttatgtgtagaaatgaaaggagagttctgtgcgcacgctaggtgctctgtatacagcgtaccacccactccaaagctgagagtggaaggcagagctcaagcaatcattaaccacagcacacgttcaggcagctttgccactaaattttaaccagtacatatataaaagtgtcccactctcctcctcatatcccatatgcacacgtgcacacccatgtgtgcatgtactcacatgtgcacacacacacatacacacacacttcaattcggtcggcttttccttggggagtagactttggtgagtaaatacctctcttagctcaatctcagctccaagcaaattgaaaatctctactaattcacaaaaaaataaaaataaaaaaataaaactttttaattaggtcaaccctgcagcttaacaacgaagatgaagaaaaagatcttgggcaagaacaagacagctgtggtttgagaagaaggcactagacttggagttagaacttggatgctggctgtgccatatattcactggatgattttggacacattcttcacctttctgagccttttcttccatgcaaaatgaggcagttggatgttatacttctaaacatgacaatgctacagcataacgaaagcaccaactgataaagaaaaagcaatgggttgtcagttcccaatgcaagttagagttgtgtgtgatttggtctagaaagcaagggccactcacttttcaaagtatccacggagaagctatgtgactcaggcaaatgcagttacagggacctggctcagcctcttcctatctgtgtgaacttgggcaagtcttttcaccttgcttaccctcagtttgctcatttcgagaaaggtgataattcccagccttgctggtttattgtgatgattaacatgagtatggaaggtggttagtactttgtctgctccttagtccttctcctcctcctccctatcctcttcctcctctcattcctctccttccccttcctcctctacttcctcctctttctcctcctccctttcctccccatcctcctcttactcctccttaatgaagcaagatcttccctctgtaagaacattacatttcttccactccatgacctggctcaagttcactatgaaaatgatcactgccagtaggaaaattcctccagaaggatttttatcacatttccctttgaagaggagcaaggaatcaacaattggcatcccttggaagatgaaagcaagttcctctgtattcggaacggatgttcctctggaatcagagtaatctcttaatggaccctgatgacataacgtggcacgggcttctcgtctgaaatggcaggttactcagcaagacagagggagagaagcagatggatgtgacagtaaattctgctatgtacccacagacacttctaagacattaaaaagtagtgcccacatttccgactcccacaacgaaacctgtgaagaaatcctgacgttgatttcaggagcatgtgggatcttgcctctcttacaatgcgggtccctcactctggttatgccaagcacagcttaaactgacccctctggttgtgagaaagtaagccaagaggagactaagattctaacaggtttattttatctactcaaaaggaacactagatctggagtctggtgaagaagattcaagctctcattctgtgacttactagcaatgacacagagggttgcctcagttgccttatctgtgaaatctaaggaacaaggaagacagtgccacatggttattctgaagacgagatcagctcctatcccttgggccactctccatctttctcattttgctctacaatagaccttgacagtttcctgtcaccagctttttccctcctcagtgtcttcgcactgtctgttccctatacctggaatgctttttcctccgctgttcccatcatcaggacctcctttttatccttcagatttcagcttaaacgtctcatgctctgagaggccttttcttgctagagcagggtctttgtccatcagtcttcaccacagctctgcttattacctcccccataacactgtccaaaatctgtaattagttttttcacctgtgtattgatgtctccctatactagaatctggacatgaaaagactgtatcctcattctctagtacaatgccaggcatttaagcatttaatattcacagaatgaatgactgtactagaaaacgcttggaggctatacagtcctatatacatataagggactatgggactatatatatatatatatatatatatatgtatatgtatgtatttatctaggacttatattctgtgtgtgtgtgtgtgtgtgtgtgtgtgtgtatgagataaaagtatatatacccaagatatttatattatattgaaaatgaaactatagactctggtgatattggaaaattcccctatataactagggaatagtccagacatggtagctcagtcctgtaattccagcattttgggaagccaaggcaggcagatcacttgatgccaggagttcaagaccagcctggccaacatggtgaaacccccatctctactaacaaaaaaaacagaaaaagaaaaattagctgggcatggtggtgcacgcctgcagtcacagctacttaggaggctgaggcacgagaattgcttgaacccaagaggcagaggttgcagtgagccgagatcacacgactgcactccagcctggacaacagagactgtctcaaaaaaaaaaaaagagagtgataccatctcataccagttagaatggcgatcattaaaaagtcaggaaacaacaggtgctggagaggatgtggagaaataggaacacttttacactgttggtgggactgtaaactagttcaaccattgtggaagtcggtgtggcaattcctcagggatctacaactagaaataccatttgacccagccatcccattactgggtatatacccaaaggattataaatcatgctgctataaagacacatgcacatgtatgtttactgcggtactattcacaatagcaaagacttggaaccaacccaaatgtccaacaatgatagactagattaagaaaatgtggcacatatacaccatggaatactatgcagccataaaacaggatgagttcatgtcctttgtagggacatggatgaaggctggaaaccatcattctcagcaaattatcacaaggacaaaaggccaaacaccacatgttctcactcataggtgggaactgaacaatgagaacacatggacacaggaaggggaacatcacacaccagggactgttgtggggtggggggaggggggagggacagcattaggagatacacctaatgctaaatgatgagttaatgggtgcagcacaccaacatggcacatgtacacatatgtaacaaacctgcacgttgtgcacatgtaccctaaaacttaaagtataataataaaaaataaaaataaaataaataaataaaatattatattaggaaaaaaaaaagagagagagagagagaatagtttcaccctgtaaagtccttagaggaggaaaaaaagcaggcctgggctaaaggtgctaaagaactacaagacaggaaatgcacaaattaccattagaataaaaactgaaaatgccatccatgctgtttgttgttcacttactgaccaggaggattccttctatgatctcaaggcagcactgccatgctgctcagcgcctccaatcatgtctcaaggtaattgggctggtagatgtttacctatctgcaaagcttagttatgatcccattaggtcatttccagaaaggttcacataaacttgggtcactttatattctttttaaacttgtcatcatgggaaatgtcaaacatagaaaacagaaaaaatagtataacaaacccccatgtatcctccactcaattttaactattttcaattcgtgactgatcttgttttgtccatattcttaccaatgttctccttccaatgcattattttgaagtgaactccagatatcatatcattcatctgtaaatatttcagtatacatctctaaaagtcaaggactcctttttacaaatatcatcacaataccatcatcacactcaaaatttaccttaatccttaatattatcaagtgtctggtctgtgttcatatttcgctgattgttctatatacttttagaaaaatcgtattcttttgacttagaatacacacaaggtctatatgattaatatggtatttatttatgtatttatttttgagacagtcttgctcttttgcccaggctggagtgcaggggtgtgatctctgctcactgcaacctctgactcctgtgctcaaatgattctcctacctcagcctcctcagtagctgggattacagacatgtgccaccatgcctagctaatttttgtatttttagtagagacgggggtttcgccatgttgtccaggcaggtctggaactcctggcctcaagtgatctgcccacctcagcctcccaaagtgctgggattacaggtgtgagccccgcagccagtgtaattaatatgactcttgagactctttttatttcattgcatttttggttttaaaaactgggtcttttgttgcagtttccaatagtctggattttgctgatgacatgcccatgatgtcatctaacaggcttatgccccctcccatatttgctggcagttcaggccagaggtagatgcagatctcacttattttgccaggaatacttcataagtgatgtgtgtactttctttaaaaaataaattttctggttgtcttttgtaacattagcaggcattgacaataattgcctggatccattagttcattaacgtttgcaatgtagggatattccaattctactattccttcttcatttattacccggaactacgccaaaaagagaaatcttcctttgtcagctatttggcctgaggaagaactgatacaagaagggcagaatacagtaaacgcatgcttcttcccccatgtatgttttcagaacaatgaattggttccctagcatcctccaagggttaccaattagttatcttttaaaatatcttattattacaaactcacggattttatgtatttcaatgccctgcaattagtatcttcattgatgcccaagctgttccatctttggccagttgatttcagattggcttctgagtccctttgacctgtagtctttggtaactgctttgctcattgcagtgacaagacactctaggaaggtttatcttgttcatttccaccctacaccttgaatcacccactttcccagtggtctccctcagtggaaaataatttaaaaaccaaactctaagtggaggagtacttagttttactaggttggttactgttctaggatatatgtattttaagtaaaaatacatcataagttcatactgatactttttaaattgacattgtatattaatatttatggggtacggtgtgatacttcaatacatgtatacaatgtgtaatgatcaaggcaaggtaattagcttatccatcacctcaaacttgtcatttcttgtatttagaacattaaaaagtctgcttttctagctatttaaaaatacacaatatatttttaactatggtcatcctacagtgtgatagaatactagaacctatgcttcctgtctagcgtaattttgtatcctttaaccaacctgtggctacacccttcctggcctctagtaaccactaatctactttctacttccatgagatcaatgctttgagcttccacatgaagtgaaaacacgtgatatttggttttttgtgcctggcttatttcatttaacatagtgtcctccaagctcatccatgttgccacgaatgacaagatgttgttatttattctttttttttttttttgagatggagtctcgctttgtcacccaggctggagtgcagtggcgtgatctcagctcactgcaagcttcgcctcccgggttcacaccattctcctgcctcagcctcccgagtagctaggactacaggcacccgccactatacccagctaattttttgtatttttagtagagacggagtttcactgcgttagccaggatagtctctatctcctcaccttgtgatccacccgccttggcctcccaaagtgctgggattacaggtgtgagccaccgcgcccagccaagatgttgttattttaatggctgaatagtattccattgtgtatacataccacattttcttcatctgttaattcagtggttgattcaatgtcttggcccctgtgaatagtgctgcaataaacatggcagtgggtaaagaatatctcttcaacatactgatttcctttcctttgaatatttacccagtaatggggttgctggatcatacagaagttctacttttagtatgaggaaactccataccgtttttcataatggctgttctaaattcccaccagcaatgtatactagttctctttctccacatccttgccagtatttactttttgtatttttgataatatcttttctgagctgagattatatctcactgtggtttcgatttgcattttcctcatgattagtgatgtcaagtatttttttcataaacttgtccatttgcatatctttaagagatgtttatttaactcatttgcccatttttaatcggattttttttttgctgttgagttccttgtatattctgcatattaatcccttgtcagttgagtagtttgcaaatattttctctcattctgcaggttgtctcttcactctgattttttcctttgctgagcagaagcttttacatttgtctatttttgctgatgttacctgtgcttttgaggtcttctctataaaaatctttttgcagaccaatgccctggagtttaccctgttttcttctagcagtttcacagttttaggttttacacgtcagtctttaacccattttgagtgtattttgtatatggtgagagatagatgcctagtttcatccttctgcatatgaatatccacttttccaagcaccatttctgctgtagctgttgtcctcagaatggtctgcctcattttccagtagtacctgatgatgatcttgaacttcccaaactctcagaggcatcacgagtaacttggtcttgtctttactttctcacacgcagtttctaacaccacatgggatttatagttgtgatttttatctacatgctcattttagaattcatgggggcatcctgtctcataattttttgtagctattatccattagtttttggttttttattacttttgttagtttgtctgttttttgaggagtgggttcaaagatatcaaaaactctgctgctatcttccagatttccctaataaacgtatctgcgatatgacactccttcagctacaaacacacacataccagtatgttctccttctctcacagacacactcacatgtggacacacactcatgcatgcatgcgtgcacacacacacacaccgagtaacttgattctccatgagactctgccagaaactaaactattgacaaaagtttcctgatgtgcccaactctctaggtgtgcttctcagttacgttgggcccaaacctaaagatgttaacttccttgtcatcagtaagaacaaacctaatgatgttattacaacatccagatatggggccaattatttatatgttcattttatatggtcccgcatttagaatagaatgaaattttaatttattattttggtttttacctgcctttatcattaggaagtgatgtttattagtcagtgaattaagaggaaaatatcaaggagacatctgcactcccatatttgttgcagcactactcacaatagccaagatttggaatcaacctaaatgtcaacagacaaatggataaagaaaatgtggtacatatacacaatggagtactgtacagccatgaaaaagaatgagatcctgtcatttgcaacaatatggatggaactggaggttagtatgttaaatgaaataagccaggcacagaaagccaagcttcatattcccacttatttgtgagagctaaaaaaaaaaaaattaaaacaattgaactcatggaggtagagagtagagtgatggttaccagaggctaggaagggtagttgggggatggtatgaggtagtgatggttaatgagtacaaaaatatagttagatagagtaagatctaatatttaatagcacaacagggtgactacagtcaacaatttattgtacattaaagagtaacagagtataattggattgtaacacaaagaaagggtaaatgcttgaggtgatggataccccatctactctgatgtgactatcatgcattgtatgcttgtatcgaagtatctcatgtaccccagaaatacatatgcctactttatactcacaaaaattagaaataaaaaacatttttaactgatattttataattatataaattcataggtacaatatgatgtttttatatacatatacaatggaatgatcacacaactttaaaggaaaagacaattacccaacctcctttggaaacagaaatcaacagcattgttccttctggctgggtaccgagataagaaaggaaatctgtagaaaatcctacaaccaaggaaaagaaatatgctactaccaagaaaaagtgcttatggagaagttgtcataacatgatgaactgaaattatgacgttaggtgaataataaaagtgaaaacaaaatgtatatacaagccaatcataaaaatatttgtaaaataataagattgaaaaacttcaccaaagagttacagttgtggtgaaattacaagtgatctttgtcgattttattttatagtgtatttctgttttaacaatgtacaataaccaaaaggctcttttaaagaaataaaatgggccgagtgcggtggctcacacctgtaatcccagcaccttgaggggccaaggtgggcggatcatgaggtcaggagttcgagaccagtctggtcaacatagtgaaaccccgtctctactaaaaaatacaaaaaattagccaggcgtgctggcgggtgcctgtaatcccagctacttgggaggctgaggcaagagaatcacttaaactcaggagacggaggttgcaatgagctgagatcacgccattgcactccaacccaggcaacagtgcaagacgctgtctcaaaaaaaaaaaaaaaaaaaagaagaaaatgtttattttgtcagtattttatctttcaagatctagatatcaccttttccttcttccataaatactacaacctcacataggtattttctgtcctccaattgtgtagagtgctagtaattcaataacttagcatcaaaatcaccctaatgagcttttcagtgtgcatatacccgagtttccttccagcaccactgaatcagaatctctggatatggtacccaggaatctatattctgaaccagcatacttggcatcattgatgcaggaggtccatagactccagtaagagacattgtattagggactccacttttcactgagcacataatttgatacttactggtatggctgtttgttattgcagagcatgtctggtccctgcaaccagattactaattatgaaaaaacagaatctaaccctaaccctaacatggcccagacctcgctaaatgattttaggcattaggccaatacagatggcctaaagactttttatatttcttccttttataaaacattaattttgtaggtgcatatgaaagccaactcactcccatttataactcagaaactatggaagcaaaaaaaatgcagctagaataatgttgttttctttgtatactgttaggcacagaagtggaattccacctattcactaagaatagtagctacctgataacatccagttatccaaatgcagtaaaataaatgagggcataagaaagcaaacaaatacgccaaaacatatttcaagagtagcatacaaaaaatatctagtcagctctcccttaagctaaggaaattaaaccaatgaccccaatagaagaaaattattagacattcaaattctgtatatttggcttaaataaaagcaaagaaagatggagaaggtctcattcatgtgagatctgtttactctgcacagcctatgtcagaggtaatggtcttaaatagttttaggaggatctaggttgaactcagatctgaaccaggtagaaacacccattctaaatggagaaaattcccaagcatggagtcaatttaatacatttcgagagtttactctacaaaagccaacatctttccagacttggggcaggaggttctctctacccaggagataaatccaaagactgtacagctaatacttggacgtgtctagcatcatgctcagtggtttacctgaatcatctctaattctcacagcaaccattttgcagacaagaaatctgcagcttgtaaaaaataagcccaagatgcaaaccctggtttttctgcctccaaagcccatatggcttccacaacaccaacctaccacttagacgcaatagaagaataccagatctcaagagaagtaggagcctgcatcactacagttgatgtcaggggcaggaatcaagagtgaagaaaaggagatgtcaagatgtctggggagtgtgtctctcctgaacactgaaggaaagagatccataggggtgtgtgtgtgtgtgcgtgtgtgtgtgtgtgtgtgtgtgtgacacagaaagaggtcttacaaacacacatttttaaatttttaatacataaaaacagtggacaaattataccactcaattttctacaatttgaacacatccatacaaccattttccaaaatcaagcttcaagatacagaacaccagaaaccttcctccagctcccccaagtctatatcaaatccccaccatggttgtccagccatctctctccttctctgtgtgtaccaattaatctctctctctctctctctctaacacaaacacacatttttagcaaagacaatgaatattcaaagagcatcttccatatgccaggctgagtgataggtgccttaaacaatatcatcttcacaacaaccctctcaagaagccattattatctccattatgaggaacagggaatttaaataacttccccaggttgagatggttagaaccaagccaagatatgattaatctcaaataagactaactatcggcccaggttctttccacaatactgcaggtccctccatgctcccacttttgatggaatgtagcccaagatcccccagaacagaaccatgataaccagacaggaggagggtcctacaactaactctcattttcccttcaagccaatattgaagacttgatatcttggtccattattctgtccaaataaggaaaggaaacaatgttgaatcttgatacgtgacctgataagactttggtgctctctgaacatccatcttctttgcctcaaaataaaaaatatagggttgatgaatgggcaaggcaatcctaagcaaaaagaataaagccaaagccatcacattacctaacttcaaactatactacaatgctacagtaacccaaacagcatggtactggtaaaagacacatagaccaatgaaacagaatacagaccccctaaaataaagctgcacacctacaaccaactgatctttgacaaagtcaacaaaaataagcaatgaggaaagaacccccatccaataaatggtgctgggaaaactggctatccatatgcaaaaggctaaatctggacccctatcttttactatatacaaaaattaacccaagatggattaaagacttaaatgtaagacctcaaactataaaaaaatcctagaagaaacctaggaaatactgttctggacattagcctaggcaaataatttatgactaagtcctcaaaagcaaatgcaacaaaaaaaaattgacaatcggaatctagttaaactaaaggtcttctgcactgcaaaagaaactatcaatacactaaatagacaacctacagaatgggggaaaatatttgcaaactaggtatccaacaaagggctaatattcagaagctataaggaacttaaatcaagaaaaaaaacaaataactccattaaaatcaggcaaaggacatgagcagacacttctcaaaagaagacatacatacagtggtcagcaaacatgaaaaaatgctcagcatcattaatcataagagaaaagcaaatcaaaactacagtgagataccatctcactccagtcagaatggctattattaaagaatcagaaataacaaatgttggcaaggttgcagagaaaagggatatttatacactgctggtgggaatataaattagttcagccccagtggaaagtagtttggagatttctcaaagaactaaaaatagaattaccattctacccagcaatcccatcactgggtatatgcccaaaggaaaataaatggttccaccaaaaatcccctgcactcatatgtttatcacagcactatttacaatagcaaagacatagcatcaacccacatgcccatcaacaatggaatggataaagaaaatgtgatatatatacactatggaatgctacacagccataaaaaagagtgaaatcatgtcctttccagcagtatggatgcagctgaaggccattatcctaagtgggttaacaagggaacagaaatccaagtaacacatgttctcactaataagtaggaactaaaattgggtgctcatggacataaagatgggaacaatagacattggggatcccaaaagggaggagggagggagggggtcaagggttgaaaaactacctatcaggtagtgcattcactacactacttgggcaacaggaacattagaggctcaaacttcagcattacataatatgtctatgtaacaaacctgcacacgcaccccctgaatctctctctctacacgcgcgcgcgcgcgcgcgcacacacacacacacacacacacacacacacacacggttgatggaaaatgaatgctgcctctagatactgactcaacagtctcaactatgttcttacattggcatttttttttttcacctgtctccttctcaaaaggtcaagagcaggagaaatttcgcctaacagagtttgtaaggtaggttttggataatactattttcttattttaagaaataacttgggctaggtgcggtggctcacgcctgtaatccaagcactttgggaggccgaggcaggtggatcacctgaagtcaggagtttgagaccagcctggccaacatggtgaaacctcctctctactaaaaatacaaaagttagccaggcatggttgcgggtacctgtaatcccagctactcaggaggctgaggcaggagaatggcttgagcctgggaggcagaggttgcagtgagctgagatcacgccactacactccagcctgggtgacagggtgagactctgtctcaaaaaaagaaaaaaaaagaaataacttgataattctaagatgccgatgtcctcattaaaaggaaaatggaaaaaggcaaatgcctggtatttcttaatgaaacactacactcagcacattataggagttatcagatttaatgcttccaacgacttaatatcaggtagtattattaactccatttgcaaagaagggatccaagtcctagatagaggaaatggcatccccaaggtggagaaccagttcaatcttggtcctctggctccagggttcagctctgaattagtaagtggtcctacaggtaaaataaatgatatgatttcaagttgcaatcatggttcttttaaaaatagatttaagggatacaactgcatttttgttatatggatatattgtgtagtggtgaagtcttggcttttagtgtagctgtcactcaaaagtgtctattgtacccattaaataacttctcattcttcacctcctcccattcccctcaccttcgagtctccagtgtctattatgccaccctctgtgtccatgtgtatacattatttagctcccacttataagtgagaacatgtcacatttgactgttttggagttgctgcacttaagggcctcaacacatatacaccatggaatactatgcagccataaaaaagaacaagttcatgtccttcgcagagacatggatgaagctggaaaccatcattctcagcaaactaacataggaacataaagccaaacaccacatgttcttactcataagtgggagttgaacaatgagaatacatggacacagtgaggggaagatcacacaccagggcctgtcagggggtagtgggcaaggggagggatagcattaggacaaatgcctaatgcatgcggggcttaaaacctagatgatgggttgatgggtgcagcaaaccaccatggcacatgtatacctatgtaacaaaactgcacgttctgcacatgtatcccagaacttaaagtataataattaaaaacaaaaaagataaggacgtcaagttccctccatgttgcttcgaaagacatgatgtaattaccttttatggctcagtagtattccatggtatgtttatatcattttctttatccaatgatccgttcatggacacttgaaaagatagggaatcaatccaagttgcaatcctggttcttaataagaagccttctcagaggataagctagtttatagaggaagctggatgaggtaaagaggaggctttataagtctattgtctctcaagctgatgttcccatgtgaagatggaacagggaagacagattctatttgctcagcagaaaaggccaacttcactctcagccagttgttcacaaacagcaaattgtttctgccctatttctttgtaccatcaaagaaaagaaacaggccaatatatttctcagttcccaaagttaaggagaaggtgtccgtggtgaaaataacccgcctcgttttagctccttccaccggaggcaaggaacaggaccaactaacatgttttctgaaacgaatgctctggatatttgctgatggggcaggttataaattgttcttgaatttatgcagaggctcactttgcatcaaccagggctaataaatcaggatgcagagaaatcaaggcagctgtgcaaaatacagttcacatggaagtgtggacagtggacaaatctgacacagagagacaatactcggctatgtaaatcggtgcataacataaagcacaatgtgcatactacctgggactgaaattatctccttctcagtcttgcttccaacactacccgttcctgccataataatgataaactctcatatctaaaaaataagataaaataaggccggtggcggtggctcacgcctgtaatcccagcgctttgggaggccaaggtggatggatcacttgaggtcaggagttcaagaccaacctggcaaacatggcaaaacctcatctctaccaaaaatacaaaaaaaaaccccaaaaaattagccaggtatggtggtgcacgtctgtagtcccagctactcctcgggaggctgaggcccaagaatcatttgaaccctagaggcagaggttgcagtgagccgagatctctccactgcactccagcctcggctacacagcaagactctgtctcaaaaataaataaataagtaaaaataaataaaataaggttggatatgggggttcatgcctgaaatcacactgttttgggaggctgaggcaggaggattatttgaagccaggagttcgagactagtctaggcaacatagtgaaaccccatctctacaaaaaaatttttaaaaagaaatagcagagtatggtggcctgcacctgtaatcctacctacttggaaggcagaggcaggaggatcactgtagcccaggaactcaaggctgcagtaagctacgatcatgacactgcactccagcctgggtgacacgaagtgagaacccatcactaaaataaaataaataataaataaatctgttttattttgttttccctaaaaattgaggctcttccattttaaatctctcctgtgcaatgggcatgcttccctcctacattgcaggttgggaaacaaagacacagaggaaatgggtggcttgcccaaagtcacccaaaaactctgtcagagagagaactcagactaaaacctaaatctgcccctaactccaacccccattcgtaaagaccccagtctccaagtcaacagaggcaagagatcccaggtccatcatgagtcaggacaggcggctcatgtggggaaaaggatgcattctttgtttttgctcctggctcagatttcggacacatcattgtaatcctctggtcttctgttgcaccatcatgtcttcttacttgcaaagagtagtctgatattctacaggaattgcagatggaaagtttatttttgaacattctgtagtgaggcaagggaagaagaaatccatcacatggaatatcaccctccatgttatcatcttacatctttggcacaaacgctcggaagtaaaggtaatagtgtgaaatacctcctttctcacttaaaaatggaatgaatgatctagatcttcaacaataggctcatttttccaatttccaacgcgaactgctgaagagggccctgcacctgtcagaatgcaaagcccatttgtcagttcctggatagtttctttcagctatttcaaggggtgacctgggttacttcccccatcttctctgtactcaggccttgtagctccttctctctaaggcaataaagtaaactgtcattgttccagagaatgtggagccctcctcgtccccaggtgggaggtgaaatgagagagtctcagcaatgggatcccatcaattaggaggaaagcattctcttcactaagttctgccctgaggattgacgtccccgagatgttaacctctgtgtgtcaatgaagcagggaaactggacagttggttcacttttctaaatgcaggagcaagatgagggaaattattgatttgtatcaaaacagacaagaagcaaatagaagagaagaccatgggcagggaagggtttgaatacaaatggaaaccaccaggcatagcattgggagcttctgaactaagtttcaggtcagaggtacctgcgtcaccacagcatggaaaaacgtaagggagaattcttggctcaccatctccattggaactcctttaccctgaaagtgctttttccagtgtctcctgttgctatggtaattagaggtattcctggctgggatcttgatgatggtgaataagcaaacaaacatacaacctcatttcatctggttttaagggttaacaagcaaataaatgcaagctaaggtgatagggtatgacaagggaggggaggggctcttggagactgactcggtcaaacagacacctgaaaagtccagggacgagctgaagaatcccctgagactgggagaaaggaagactgttggtccttggtttcatcaaattcttcaatgtatttcctcctatcatccccttaaggttaagagtatctgcaagagagaatggttagagaaggccactctgaggaagcagcatctgagctgaggcctgaattataagaaatcagccccctggagactgcagagggtttggaaaagggaagagggaaagcaaggctaagcccatctaagacacaaagaggtcaaacagcacaagccagatgtggtcaagagaatctgggggacaaacaaaagaagagacatttttaagcaggttcatggaggggatagatgacgaattaggatttttaaatggatttctaagcattaatcccctcaggtttaataaagacaagaaggttgttgctgttgttgtcgttggtggtggtggtggtgttttggtcaagatattgtgaagaagaccagccctttcaggctacagtaacacaacttccaaggagggcttgggtacaagtgagcaaaggaaggaggggtccaaaccagtctattcactcccagtcataatgaaacttccccaaacacataaatcacccaaggtcccagtcatctaataacacctctgatctcccagtgtatgctatgcttataatgtttgtgattcttgcacttacattttccaaagccctcatcccctttcctttgagtgggtccccctatatcctcagtatgctttttcaatgcaagggataaatgacccccttaacactagcttccatttaaagaggggatagagaagtaaggcttatgggatctatgtgggatcatcaatgagtctaagataataacagagggatttgcagggaggtagagaaataaactaggagagctagaagggcattgaccaagagtgagcaaagaggtaaaacaatagatcaaggaagaaaaggaataggaggaataaaaagaaagcaggcagagggtggcaaaaaaaaaaaaaaaaaaaaaaaaaaaagaaagaaagaagtaagagggaagagaacagaaggaaacagagaaaggaggatttggaaagtaaagaaactaaggagaaagaagtatggaaataaaataataaaagaatgggataagttgaatgtcagaaagagaagatgcgagccaaccaagaaaatgacagagttacgtagggtggaagggcatctccaacaattaccccaacctgcatcataacctgcctctttcaccttccagagggagcagacctcattctcttctaccacattgcattgcgtgaaaccactgctgacactccctcccacgatgcaggctccctgggctcccctgagcagctattctttcagactcaggcacgcatgaaaattgagttcagctaaatgcaaactgaactccagaagacctgctcctacccatcactgtaatcgttaagggagaaaattaattgcctgaggccagagtgtcgaaatccaactagacatctcctcccaagtgacctgtccctgagcagattgtggtgggcacacctgtaagtaatattccaacttcatttgtctacacataatttcccttgtcaggatttataatcatatacacatagctgttgtggtttttatggagtttctgtctttcccaatacaccataagctccaccaatgggaagaggctatacctattttttaacactacagcacctagcacatagactaatcactcatcaaaaattctcaatgatggagagatgaataggggtggggatttcaaaccaggactcacagttcttaacaaagaaaacagaataaaaataaaatgttcatttttctggtctgattcctctaacaccaggtgtttttttaaatcataaaattatctctcacatattaagtagctaattgctatgacatttcaaacaaaaaaacgccaacctttacacaacttaagtcatgctctttcgttcctttaaggaaaccatgatttttttcatcatcaccagcccaaaaatgtatcatcctgacaacacagaagaaaaaacaacttgattaatcttggaaaatttcctccaaaatcgaaacactgattgctgagttaaaactcaaaacaggagctctgtcctgaactggcctgtagactttctaacactggaacaaaccagtaatcactagtgttggagatgctataattgaagtcagcttatgacaacagggaaaaggctgagtctaaaagctctcaccattcaacactccccactcccaatgttcccactccaaatggtacagtaatggtgtgatgataggtccatccagattctatcccgggggatctcttcctgtgtgtagccttccccctacactttttcttggtatcattgatctccttctgtttttcctttcttttcatgttttctttcaatttgattcatttatatacacatatgaatatattctcctttgataaatccaaacattaagagacaaagctaaagccctcttgactgccatccctaatctcaactcatccccaacatcgaccattcttgtgttacatgtttgttgtgtatccactcaaacctctgtctatgcattgatgtgctaatatggtctggctgtgtccccacccaaatttcatcttgaatcatagctcccataatcccacatgtcatgggagggacccagtgggaggtaagtgaatcatggaggtgggtttttcctgtgctattctcatgatagtgaataagtctcacaagatctgatggttttataaagggcagttcccttgcacatgctctcttgcctgccaccatgtaagacatgcctttgttcctgctttaccttccaccatgattgtgaggcctccccagccatgtggaaatgtgagtccattaaacctctttttctttgtaaattacccagtcttgggtatttcttcatagcagtatgaaaatagactaatacatgtacctactacatttatttatagaattataacacctcattccataactttttacacaaataataggttatgctttttgttctataactgtctgtttttacccaaaaacatgtcttggagacctctccataccagtatgaggctctactttattctactagatgaatctttcccatggtgctcatgtgtcatgggttagccatggcactgcgattgatatttagtccatatctgttgttatataagagtggcatgaacctcgaaaacgtcatgataaacgacaggagccaggcataacactgtatgattccattcacataaaatgtccagaataggcaaatccatagagacagaaattagattattggttgccagggagctggaaggatggggcatgttgtgtgaatacttaatagatacagaattttcatttggagtcatgaaaatgttttggaagtagagatcgaaggtccttgcacaacattgtgaatgtacttaatgtcactgaattgtactctttaaaatggttaaaatagtaaactctatgttatgggcactttactgcaataaaaaacatagaactgccagatcacaaagtatgctctttaaatttttataaaaattggcaaattgccttgcaaaatcttactccctttatgtttttgtattactgtatatatctctatgtatctttctcaactaatttcagaatcagtctcactcttctctctctctctccttctccctccctccttttctctcccccttgccttcctctccaactctctaacagttctgacaatagtcacaaatactcctcctccccctcctgcaaaaacttttcaggtcatgtatcagtttcaattacatgcattgctttctccttcaggacttcctggatggcttgctgagggacataaacatcctaggggtgcgggtagggggtgtggaatatacaaagaatccttatttctttagtcagctcagagccaatggaagcattacatcagcagaacaaacaatattaaattagaggttccaacaactcacaattcctattatacaagtgtagtattttcctccaaacagcacagaaacttacactgaaagcagcttcccaggcacctgctggcccaagaaggatgttcttatgtcaaagagtttccagctatattagagaggtagtagagtcagtggttaagaatccaagttctggtatcagactgcctgggttcaaatcctgactcaactgcttaactcaagaagtgaccttggcatattaaacttaccactctaaacagcattttgtaatctctaaaatgaaggattgataagaatcaagctgtccatcaatgagactggataaagaaaatgtggcacatatacactatggaatactatgcagccataaaaaaggatgagttcatgtcttttgtagggacatggatgaagctagaaaccatcattctcagcaaactaacacaagaacagaaaaccaaacactgcatgttctcactcataagtgggagttgaacaattagaacacatggacacagaaaggggaacatcacacactgggcctgtcaggggttgggggctaggggagggatagcattaggagaaacacctaatgtaggtgacaggttgatgagcgcagcagaccaccatcacatgggcatacctctttaacaaaactgcacattctgcacatgtaccccagaactgaaagtatatatataaaaaagaaaagaatcaagcaagatacggaggctaatcactgatcacaggctctcacacagggggtattagtttccatttgctgttgtaacaaattccacaagcacaacgacttagaataacacacaattattattctgcaattctgaggtcataaattctaaatgggctcactaggctaaaaatcaaagtatggacaaagctgtgttcctccagaactctaggaaagattccatgtctttgcctttccaggttccagggagttcctgcattcctcccctgagcaccctcattattccacctctgtttcctctaccttcactatacatctcctcctctgactctctccctcctgcctcctttcttcccttataaggacccagtattattacactgggttgacctgaatagtccaggataatctccccatttcaagagccttaacttaatcacagttgtaaaatctcttttgccaaattaggcaacacatccactggttccaagcattagggcatggacacatttggtgagtccttctcgtaccacatgtgaagaacatgcatgtgttaaccactgcggctatttctacactactcctactattacagagaaagaaagtttttttttctcctcctaaaaggaaaataagtagcagtcatgtctcagctatcaagagaaagggtaaaaacctataccctcattccttgaaattcctctaaaattacttaatatattgcttttcttccaccagtgggccacttgttggaagtcctaagcagtgagttatgttctaaagcactattaatagtctatagagtcctttaaggtactttagcatggaataagggaggaaacagaggagagagaacagtgttctgggtaccttggcctaccggatctacactgatttcattgtattaaggaagacaaaaaaacaaagattcttccctatccatcatgcttctttggttttggacagcaccttgtaaatatcattttcctctttctcctttttcttctcttccgctgctgtcttcatttatttatttttctatttctccagaaatgggtgcaatactgcatatcttcagcttcttcagttttgtactcccattactttggtcctagtcttggttatactcaaagggcagatttcacaaatgaactctagactcctcctgggcccaggaagtttgtcctgcttaccatggccataatctgtaggcaatgactctccatccctgagacccattaatttaactaggatgataaacagaaaaataaataaaggtgttgtgatatggggaagaaaagcagcatactgaggtcagcctaccttacccgtgggccccaattgtcctgggcaagttacttttcctttcttcgcctcagtttccttatctgtaacatcagaggctgagcaggatgatcttgtgggtctcttcaaactctgagattctatgagtctatacaaagagtgtttatccaaaccaagaacagaggagaagaaatggcaccaatattggaaccatgaagtcctgggtttaaattgtggctctattatctactacctgggtgcatctatcaggtaggattcacctggttgcaagtgacagaaaattcaaaccatcttaaacaatagagatacataagcttctgtgactggaatgaccagtggcaaagatggcttcaggagttttcaagtcagtagaccaatgatgtcatcaagattttgctccttccaactctctgccctacataccctctgctgaaactatcttatggctgatgccccatcgtgaacacaacatgggaacctgccaacattccacaagtgcttccatgcatgctcttgtatctttagaaggttctcagaagccctccaataaaatctcccatctcatcgttcttaactatgattcatgctaatcaatgagccagtcaccatggccagtgaatcagaattgcatggattggcttaagcctgagtcacatggcctgcttttaccaaaggacatgaaattcatggggtaggcacggatatccaacgggaaattatggcagttaccataagaaaaaagagcaaatttgaggagagacaaataaaatgtccaccacaacggcctttgagaatatatttaacttctcttagtttcagtttactcattgataaaccaggataacacctacctttaattaggattagatgcagggatatttatcaatcattcattctggcatttagtttaccctggcagcatttttctaataaaatgtagctactaatatcatcattattatcagcaccattaccactagagaaaaagctatagaaactaacacagcttcctttggctcttaccaggtgaaccttgagaaatctctgagatggcctcatgtatcacactagagcttgcaaatggcataaaataatcagataaaacaaggtacaagatgaggaggcatcaggttccttaatgctttaacatcagctcagtgcaaatggtgaactgatagttcctctgagcccttggaaatacaatggaaatcaagttttggagaaacagaataatcaaaatgggttattgccaatagatctccaactaagggacaagaagacataatagatgaaacacctaatctgtggaatacattcccctagggagagctgaccacagatggaatggctattcaggaaggcaatgagaaattcatctctggaggctgaatgaccggtttcacggattaggtgggtaagagaaggaagtcagtgtagtcatctataggtaccttcctcacagtaagcctggaactccatgagagaagttggaaactgagatgcctacagaaagcacgcaggcaacaaaattgagcaaagtagggtgtgtagagtgtgagatgagcgaagggttaccaccttatcccaaggggcaatgactacacaactccagcttctgtggtctgtggccatagaagaatacaacttgatgttgccagctctttcagtatttcaagacaatccagaattcaggattttgtgttaaaatcttcctattttaacagttggtaaaccatgcacatttaagattttgtgtaggacacatttgtgaacgagagtcacccaatggactttggagaaaggcatttcatggcctttaggagaaaggcaattttcctactggaaaccataaggccttttattcttgtcgaaattcatcagtactttgtaaaatggaataaacttttaagcattaactagcagaaaaatctgccatattgctgctgagtgagtgtgtagcaactgacaattatggacagtagaactcaaactagctcttgatgcatgggaagcgaatacgaggcaatcagtttaaaattagaaccacatttcttagaggcctccatctgtcttcctacatggggagtatggagtccctgatccttcatctatttttgagtggccctgtccagatgaagagcagaaacagaaatcctggattctgattccaatgggagaggcatggaatggtcaaaagggtggtagaagaaagagaaaaacccatgtggaaagtgttcacagcagtaattaccataaaggattccagataagatatctattatgcaggaaaaggaaaagacatcaagattagctagggataattaaagaacaaagttagtgaattcaggaaaaagctggataggcctgctaaaagattaataaaaagagaaaaaacgaacagagatgaccatggtattgtttgcattattttggatatggaaggcaggaaaccaagaacacagtgggagtataccaagtagagctgagttcttggacaaggctgaaattgtgcacactcccacttctggttgccttagcaatgagactcccactttatacgaatgacatgagaatgagtaaaaccttatgcaaatgaagcacacagtaattagaggcagagccacatggagtctagatgaggccatgtcggcagaatatctagggaatagtctgagtgggcttatgcagcaaagaatgaggtcattaaagcaaagacactgagctatgagtaagaggaataagtgcttgagaaagactgtgggttccacagacttgttggttctcccactgattttggtcaagttatttcaggtaatggatcatgcagtcacacgtccgcattgcctcacctgctctattttactgtgtctctcctgggaagaaatcttggaaaagggtaagaaggttgtttactgtcctggttccctgtgtgtgctgcctctcactattacccatgaaagggaatcaaaagggggctgggaaagtttcacggagagggttgagaactcacaaataaagaggacaattaggcccggcatggtggctcacacctgtaatcccagcattttgggaggctgaggcgggcacatcacgaagtcaggagtttgagaccagcctggccaatatggtgaaaccccatctctactaaaaatacaaaaatcagctgggcatgatggtgcgcacctgtagtcccagctactcaggaggctgaggcaggagaatcgcttgaacccgggaggcagaggttacagtgagccgagatcacaccactgcactccagcctgggtgacagagcgagactccatctcaaaaaaaaaaaaggacaattatgggatgtttcttacggctgctgtaacaaattactacaaaccaggtggtttaaaacagtgtacatttattccttagagtcatggatgtcagaattcccaaatcagttgcactgggctaaaatcaaggtgtcagcaggggtgtattctctgtggacactctagggaagaatccaattccttgccttccccagttcctagaattgtaatcccagcattccttggttcatggccccttcctccatcttcaaagcaagaagcacagcattttcctttggtcatcaaactgtcatcttccctggtagtagaatctccctgtctttccctgatgaggacacttgtgattatattgttgggtccacttggataatacaggaaaatctccccatatcaagatgcttaacttaatcacattggcaaagccccttttgtcatgtaaggtaacatactcacaaggtcaaggaattagaatataagcattttgagggccctttattcagcctactacacggggcaagagagagtagaagtggaaaggaaagacaattttaagaattgttacttaaagtgcattataaattagatgcccatgaattttattgaaaagacaaaagtaaaacgaaaatttatttttataaaagctctgtgtttctctgaatttacaaagttttgaggctagaatatatggggcactggtaagtatgtaggttacaagcatgaatcaaataaaataatcatttgaaaaaattgcatctagcaacatgcatcaaagtaattagtttaagaaattacttctttgccagcacttattttaaataactattgatataaaaagtgacagcgaagatttagatatcagaagctacttatattctgggccaatgtacccttaaaagttgatttctctcctgctttctctcagacaactgctgtttatatttgtaagcttgtgcaattccacaaactaacaaacatgagtataacattttttattactcacattaactgctatttttcaatccaaaggaaaatgaaggagaaatttcagagcgatggtcacaaaaccaaattttataggggccaagtgtgtaccatgagtgagtgaagtggtccagatacgtaaagaggtaaactgggggggtccacgccctacctggagaaaaagatattactcacttccatctgaatactgccatttcaacagacagtatcactggagcttttaaatctttaagagaagtcaaatatccagaatttcatgtaacatctcctgatttgtaaatgttggagactaagtcaaagcaccatgtgggctgaataaaactcattcatcctgtggcctgtcactttgcaaattccattataaattctattaagtacttttcactttttaaacctaagacaaaaaggggaagttttcatccagtgaaatgacatgatcacatttgtgttgaatttatttctaatgcaaccacatatacacagtgacacacacatttacacaaacctctgagtgtatgaataaactacctttgaaaccataagttcttaagggatagctttttacctcaatattacagctttggccagcactgagcaaagactgttttcctttcagtgaagatctatgtaaggatgtaggctgttgtaataataacctacttcatataagagaaaataagctcccaaatacaatgtgattagcctcagtggtcaatctaagcacaattgtcccaggaacctggacaccatcctaactgcagtcgtagaagtcaccaactgtgctctcctggcccttggtcaggactgcaatgaaatcgtctcaggcaaaggtgcatgcacccagatttttaaacccagtttttttacaatgcaacttcaacatctgcatcaataaataaaccacgtgaacaaccaaaacgacttttttagacagtgagaagagctgtgtgcaagacaaaatgggccatgagatagagagtgctaagggggagcggtcaaggaggatctatcactcctaaagagatgacattctggctgtggctagaagaacccaatcatgtaaatttcattttatttcttaaaaaatgttatgggtacatagtgggtgtatatatttatggagtacatgagatattttggtacaggcatttaatgcataataatcgcatcagggtaaaatgaggtttccatcacctcaagcattcatcatttctttcaacgttcctattgtactccctcagttattctaaaatgtacgacaaattattgctgactacagtcaccctgttatgctatcaaacactagatcttacgcattccatcttaactatattttttacccattaaccctccctatttcccagcaccctctctcacaactacccttcccagactctagtaaccatccttctactctcttctgtgttcaattgttttaattttcagctcccacaaagaagtaaaaaacatgcaaagtttgtctttctatgcctggcttatttcacttaacatagtgaccttcagtttcatccatgttgttgcaaatgacaggatctcattctttttatggctaaatagtactccattgtgtatatgtaccacattttctttatgcattaatctgttgatgaacacttaggttgcttccaaatgttggctattatgaatagtgctgtaataaacatgggagtgcagatatctcttcaatatactgatttccccttctttgggtatatagttgacagcggaattgctggatcatatggtagttctatttttaatttttgaggaacctccatactgttatccatagtggctgtattaatttacatttctaccaaaaaagtacagggttccccttcctccacatcctccccagcattcatcattgcctgtcttttgtaaaaaagtcattttagctggagtgagataacttattgtagttttgaattttatttttctgaccattagtgatgttgatcatgttttcatagacctctttgccatttgtatgtcttcttttgagaaatatctattcagatcttttgccaatttttttaattggattattagatctttttcccattgagttgtttgagctccttaaatattctggttattaatcccttgccagatggatagtttttaaatattttctgccattctttgggttgtctcttcgctttcttgaccgtttgctgtgcagaagttttttaacctgatgtgatcccatttgcccattttgctttggttgcctgtgctgtcggggtccacgtaaattttaatttagggggctaaaagttctcggtaaagggaaatagaaaagcaaatggcctttgacaggaatgaacacatagatgtaagtgacaagaggctgtgtagctggagacagatttgaaaggaagaaaatatgattgacttggagacactgacatgggcagataagaacacaggaggactttagaatggaaggtcctaagcaggaaggacagtcttatttgtatctttaaaaaagcttactctgacaagtcattctacctctttgagcctctggtacatcctctataagatacaagtagtattctttttttcacagggctcttaagaaagttaaattcgatcttggacagaaagtacatggcatacagtaggcactctatgaacatgagctgaacttgaacatcttggggggaagtaataacaccacagagaggaggcagggaatgaaggtattggagatctgtcctcttgagccttgacggctcctgcttctaagagaggtcatgatcttatgacagtgccttccccaatccccttatttggatatcccatggctatgcaacagctgtgccccaactagtaccccatggtggcttccaacagcaaaactaatttggttgtgtcatgctgagatatccatcttctaatacaaatgtaacagattagcatacaaagaatggactgctgttgaccacagggagtagtaagactaactttaagaagcttgaacagcgtgcagtcactcccctactgctgttgttttgtagagcataagaagtgggtggagttgtttccaacaataacaatcaaaggaccaaagaccggacccatgagcactgtgattcttccctgagcatacaataaaccaactaggcaatgtttacccaaaacagcaacataatctcagaagcagcagttccacacataggtaacttcctataggtactcacacttttaggcagagatctgtgcaaggatgttcaaggcattttttgcatgtaatgtcaagagattaggaacaagctaggtgtccatcagaagggaattggtcacatccattagggtacattttcaccatggatgcacattccatgcaactgttagaaaacaaaactgatttacaggtaccaacaaataataatttgaaaaacatggcagtaaatgaagaaagcaaggtgtagaacagagcacagagttggctaccatttgtgaataaaaagtagtatatttatttgttgggtctttttggtgccagacattggagatttagcagtaaacaaaacaagccctggctccatttagcttacactctgatggagagagacaggcaatacactaatacagatgaaaatacgttatatgtcaagtgctgataaagtcccgtatttatgctggaatttgggtgaatcatgtcaatttgctggtaagtgaccactttgatccataaagaaggtgattttgaaaggcttagccaaatacatactcagacaaaatgatgtacaagaaacagcaattcctccaggaaggaagcttagaagaaaaaatacttgctagacacatacagatgctgatttaatttttgtaatcccatgtgggtattgcctattcaaaacaaataaatatttttaaaaatgtaatcatagaaacacaatagagttgacacacagagaggtagaaggtaggtaaggatgaagtgaggattaggagctaagaagaggtgaattttttcaatgcaaaagtaggcaggtgagagcgacatactgtaatagagtatgcgccactcgaaaccataagtgcccttttatttgtgattcggctcaattcccaaggacggcacaacccctagactcagaccaggaaaggcagtggtaacaaacagggagacctggacaggatgggggttgcaatagagtctgtgcctgagctcacctgggcacccaccccacatgttcctcaagggtcttgcttgcagggagctcagtgatataagcacagattgcaaaactaagccttccctttatcaccctcagtgttcccagtgccttgctcaaatgagaaagaaaaaaaaaaaatcaacctgccaatctggtctttcctgcagtaaatgaaaactagctctgttcctgcatagaacagaagagtccaggcagctaagtcacatgaccggagacaaaccagacagaaagaagtcacgtgggaccacaatgaacaagaggcagagacaggccggatgatggccaaatgcacaatgaaactggaactgaggttcctaaagatgctggcacagcgttgcacagtcacttgtcttgggccagaccaaagcacagtcccctctactctacgagtgaggagcaaggcccaaagaaacaagcacgactgtgaattctgtttgaattcctgctttctactccctagtactgtgccctcaggcacatagatgaacatctcagttcctttctcctttctgataagggtagagaacagcaaggcctacctggttctttccttattttattattatcaagctgttcatttcagcacatatatctagcttttactttgtacactaatacaagaagaatcctcacctaggtgagtttccacagccttatttttcttagtcctccagagttttcaagagaaccttattccacagacaggaaaaataactaatgggtactaggcttaatacctgggcgctgaaataatctttactacaaacccttgggatatcagtttacctgtataacaaacttgcacatgaaccctcgaacttaatataaaagttttaaaaggataacatttggaacctggagagcattagcaatagtacctacctgtaaaaatgttgtaaaattaaataagatcatgtataggaactgtttaatatacttcatagtactttataggtacttcataggttcataaatgcttcccaccgttattattgcactgtgaatactatggatttgcagcattaacaagtgatgactaggactcagctcagagaggaggagaggagaggctactgaaggttcatgcctccacccccaggtacgtgctgaaaaaggaatatctccccttgctcctccagaattcttaccttgtctctccagggaggccatgtatttatactgcactggtctcttcaccaggactgctatgctgcacaactccagggggcagcaatcatattatatcctgtgagcatagtcctccaccccacccttcacctgaagttgtggaacatggtgtccccatgtgctaaacgttcaggcttgctgggttattcctgtaacatttgttctatatcccagtccaacttttcatggtgacatccaaagttcccagccaccaatgccagactcttctttagcatcagtaaccccacaaacaactgggaagaatacttatctaccttccccactctttcttatttatgaatcagtttgaaattacacggtaatagttgtgcctgcattttgaagatggctcttatcagtaattacagatgtatgttaaactaagtttttaatgctaagattatcttcccaggtgtttacattagaaagaattctagatttggagataagtggagacaagttcacccctgaatatttagtaaggtgctaaggtacctgtgggattgcctgagttgtgactcttaagacattgcaagtaaaaagttacaactgacatcagcatccaaccattcttctgtaagtagcaatattctatttccttttgccttggtgggtccatcagtctacgtgtctactctcccagggccaaggcgggacccaaatcaaccactcattctccaaacatttccaacacaggaggaaaaacacaaggtcagggccgattcactgactgctgtgtgctgaagtaactgcctgtcagatcctccttcatggatccctagagaggctctccttattcattgcagatgcacgctttttgcagagcacccttgaaacatgctaattaattatttttttttaatctaagttacccagtgttggtttcatctacctgctgccctactgcagaatcagaaagtgggaatctgctttgtggcgggatgacgttcaccaagcatcgttcagggctggttcaccatgatgcctgtccaaacccctgagcacctagtgtctgtaccacacatgtaagtacttaatcacatgctacaccaagctgctcatagtttcaccctataactcttgtctctgcagacagacaaaagcttttctggaggctggagaccatagcatagataagaggtcctcaaaactaatggatcatgagcagctgtgaggtgtgatgcactaattagttaggatcccagtccaatcagtgatacttggaaatgattttggctttttttgtaagctacagcacattcaaggtcatttctataataacatcattcttactcatttacaatctgaaatgttttcttgagtgggagcgaaatggaaaaagtttttaatgtgttatgctttgtcttacatattctttaatcctgtacagaacagagcacagattcaatgttgaattgaactgattatgtgacatcctgcaaacaataaaagcatcacttttaaagaacttaaagttccttctcacaccttttatacctgatctccagcccctcaaagggttgtattaatgcatttaaccctcatatgctaaatttcatttctaattataggataaccacaggaaaaatggttatccagaccagccctttaactcaagaatcacaaatgcaacatctagcatggagaagcaggtaaagaaaataatgtaaaccttgttcaatcgattctaaaagggtggccatgtgggacaggcagaacaatggcccccaaaggtgtccatgtcctaatccctggaacctgtgaatatgttaccttacatggcaaaagggactttgcagatgtgattaaggtaaagatcttgagatggggagaaaggacatttgaaagtagagtctgagaaagatatttgaagatgccctggtgctgccttggaagatgaggaaggggccttgagccaaggaaatcaggcaaggaaaaagcagcttcttcccctagagcctccagaaagagttcagccctactaacaccttgattttagctccatgagacccatttcagctttctgacctgcagaactgtaggataataaatttgtattattttaagccagtaagtttgcggtaatttatttcagcaataggcaactaatacaccatgtatcaactgcaaacaattgttgcagttctagaaagctggcccaatttaccagttcttgggtgggaggcggtagaggagcagaaaagataacttttgagtactgagattaatacctgggagaggaaataatctgtacaacaaaccccagtgacacgtgtttacctatgtaacaaaccttcgcatgtacccccaaacctaaaataaaagtttcaaaaatctggattttaaaaagagatccatccctagatattttcgtgaatactcattggatttttacagcctctgaggtccagggtgtatctatgggctggattcagcccataggctgccctttttcctctgttcctctcccacgaaagccttccccttgctttatcctgaagaatggccatccagccttaagcatccacatgatggcagctgactgccttcctaatcatcatcccaataagtgagagctttaatatttcaaagggtctgctctcaagcacagctaatttctctctcccttatagcttttgcccacaggtcctactcttccctgcgggacagtaactagtggctcttgtttctcctccacaggacagcccttcgtatgtttgaagactgctctctcatgccctctgcctttcttcctgagaccttcctggaatcatagctcttctctctgtgctcattctgtctgacccttctaaaacgcaaagattggtaccaaccagcatcctcctgggtcaggagcaaggacagcgaaaccatgaccactgaagtgtttctttttaactacaaatcatctaaactctccttaaaattattcaatctttttccaggcaaagagattttctttggtgaagagaaaaattgcttaaagtggtttgacccacacctctctctctggcctccttcctcttcctagaaatccagctattgattcagcttctactcatgcctgtaatctcttgctcaagcgtcacttcctcaacgaagccgtctcagaccagctaccagtctgggtcaagctcctctgttgaatgatattttcctttagaacattcagctctgtctgtaattacacacagttactgtgacttcgttatttgatgcctgtgtccccgtctagattgataagctctgtgagagcagagtgcaagcctgtatagcctagcccagctaataaatgggtaggtggtgagttgtgagtgaatgtgtaggggagtctgacttgtcaatattctgctttattatcagaacaaatgaaaactccagtttttggtcattttcatatggctggataccttccccttctcaacctggcacttgtagaataaattttataacctaaatgcaagaccagtatgtatgtctcttaaaggataccttgacaactttaccctgcattctagtttagtaaaccatatttgaagcttgatttcattggccactatatgttcttttctcctggccttataaatgtacacatttcttagaaaactcgggtcttcattcattctacaaacatgtcttgagtggctactatgagccaggctcagagggtagctgaagataaataggtaaacaaagcatgagccccacccttagattactcagtctagcaggacagacagaggcataaatggaccactctgaaaccaagtgttgaatgccattataaagaaagttgggttctgtggtgtaagtaggagttaacgagatgaggatggcacaggagtcccagacaaagggaaactcattaccaagaaatgagggtgtctcaagaagtgacaaccgttttaagtcatttaaacataggtcagagtggagagagacaagcctagaaggccatgaacaaagagacttatgcagtgagttaagcaatatggactttatcaacaagtaatgggttattaataggaacatgacatttatatttcagaaaaaaaaatttagcatctacaggaggatgagtgaatagaaaagcaggaggacattagaaggttgttataatcatttaaataagaaataactggacaggtgtggtggctcatgcctgtaatcccagcactttgggaggccaaggtgggcagattacctgagatcaggagttcgggaccagcctggccaacatagtgaaatctcatctctactaaaagtacaaaaattagctgggcatggtggcacatgcctataatcccagctactcgggaggctgaggcagaagaatcacttgaaccgggaggcggaggtcgcagtgagctgagatcgcaccaccgcactccagcctgggcaacagagcaagacttcatctcaaaaaaaaaaaaaaaaaaagaaaaaaaaaaagaaaaagaaaggaaaggaaaagaaaaaaaagaaataactagaatcttactaagggtaggaggaaagaatagagaggaagaaaaagacttgaaagatccacaatgtctataaaacagatctaagtacagagacctgtggcctacctttggagacctacttccaggtgacttattttaactcagtgacacaacaactagttcactcaggcaaaataataacaaaaatatttttttcaaaaaaagactccctgattccgaatgcgctttaaatttctgaacatacttacatttggaaaatcattttgcaagataggcagtttgcactagattcatttgcatgtatataacattgcagtgtaagctttcttctaagcattttcacctgcttcatcacccattggctgcattcccccagcaaacatttattgggaacatactatttacgaggtgatggcaactgcaggggacagggaggtgcaacaactcagcccctgcaatgaggcaattcaccatcagtgtgggaaatggacagccacacagaacctcattaaaccatgtggtagggtagctgggcatagtggctcacactgtaatcccagctctttgggaggtcgaggtgggaggatcacctgaggtcagcctggccaacatgataaaaccccgtctctactaaaaatacaaaaattggttgggtgtgatggcaagtgcctgtaatctcagctactcaggaggctgagacaggagaattgcttgaacccaggaggtggaggttgcagtgagccaagatcatgccattgcactccagcctgggtgacaagagtgaaactccatctcaaaaaaaaaaaaaaaaaaaaaaaaagtggtaggcatggcctgagcacgggaaacccagggtaatgtaagaggcgcagagaagaggccccctaattcagcctgcaatggtgcagtggagtgggggacagtcaggaaagacactttggatacctgagcgttgtttggtttcccatgtagcctgtggacttctcatggtacatgtttcatctgtcaccccatccaacaatcagcacacagctcaaacaagatggggtcagatctccacttcatacacactggatttccacacatgcatgggaaagaaaagaaggactattgccccacagattcactgcatctagtattgctaaggggctgcagcctcttgccaaccacagacccatctcagtggacaatgcaaagggtagcattaaatcatgagctttgtgagggcagggagccctgtgcctcctatctggcatagcatcccacacctggtgggtgcctagtaattgtccataggataaatggataacaacggagagacgaagaatttattgtagttgtgtttttgcaatagtttctctcccccactgggtgattattcatgcactgcttctccacattagggcaaagtgagctcacatctctcttacctgctctctgggcctcccggcctggactcgcacaagggcaccatcccactacccctcatacttccaatcagtgcagaccagagccaccccaaccccactatcatcactcacatgagcagcaggatggagctggcacagaagacaagcctcctacacctcctctgccaaatcttcaaatatcatcagtcacactggaaaatggccccaggccactgctgcttaatgggccatgatggatgaacacagatctagagaaatgattgtttaccaactaagggatcagagcctatgggcctctttctgtcctctgaagagcatgctgctactggggcaaatgagtttgagtccagagccgacaatgagcaggtgatcaagccccaagtgaaatggcctacaagcccctcatcttctgaccacaaaaacaccataggaacatagagacactgccatttttttaaaaggaaccttatgaggaatacagacaaagaaacagataatcattacacattaagataatcattacacgattaatagataatcattacacgttgttaagtgctacaatggcagcatgatagggcacttgatgagtcttggtggggcggcagtcagagaagactacctgggggctggggatcatgaaagaaggcaggaggggaaatcatttctgcacaggttacagtagactgagtgcatgttctagagccaaacagccttggttgcatcttggtttgttcggcttatttcgagctatgttaattgcaagtcactactctctgagggtctctaagtgctctgagaaatatgaacagtaacagttcccagctattgtgagttgttgtgggggttgtacaaaagaacaagcataacataagaaaagcataagaatgagcctgagacactgtgagtactcagtatacattggtcatcataaccaggactgcaagtacagcaaggccaatgaagcacttcctttgggtgcaacatttaagagggtgataaatgactcatcagtcaagataagtaatattttaatatgatatttttacaaataaaaaccaatgcaaaaaaaatgatgcaaaacaaatcaaaatttaaataaagacaagatccgactgtacttgcccaaccttagtctcagccctgctggatcctctattattatgttaatcatggaattcttggcattaatttctattctctaaaatattgcactgaaatggtatttaccttgataacttaattgtttggcacccttttaaattttgcatccaaggagggattcttaatctcttcttccttgtcctggccctgatacgtggctttccaattttctacgatgagagtagttacttttacatttagaagaatcaaatgatatgacttttttaaagagatgagttattaaaaggagacgtgatcagaagacatttagcttcgtttaggaggcaaagcagatgcacgtgggccatttcaaatagaaaaccataagactgtatgtgaaaaaggaccctaagatgaaacagtggtgggtgttataagaattctgatctcagtaaggtaagaggaggctggtgttttccagaaacataagagaagaaggtggggtttctgtgctagcaccagaagacacaaactggaggcagcaataccactgcagttgatgtgacagaagcccctggagaagagttcaccaaaacgtgaaaggggagtccagcagctgcgtgctaagggggtgtggctctcagctcaattctagcctgaccttcttatagatggctgagagaaccctagaggctatttcacgctgtcaacactaatgatacttctgctgagagaggggtgaacctctggtccacctattgctgatgctgcacgagggaaactctatccagggaggtgattgtcctggtgccacggcactcacagctgggcatgcctgcactgccagtcactccccacacaccgtgcaccccagctccgctttcaccatgaagatgagcaggaaagaaaactcatctcccaacccgaggttgctctgattctctaggtcccagaatctctgagttgcagacaccttggaaatcctcattgtcataagcaagaatgccccagagttacagctccaccttcccaatctgagcactggctgtggcctgccttcagtgactttggaccatgccagcagctcagaccccactttttctcccaagttcccccaaacctcaagaaaaaatattttttttggaaaacgtgtttttaacaatgatcatccatttcccaataagtccaaggaagtgttgatctccaaaaaaaaaaaaaactgaatcccaacgtaagtttgtgaccttgagcaaattgcaggatctgtgcctcagttgccccattaataaaaagagggaagtcacctcactgctaacacttcattagtaaaataaggacactaacagtaccttcatgtgtggcgagtataaggataaaataagatataaacatttgacacagtgtctggcatgtgacaagcatttgatacatgaaagctactgtttatcattgttttataattatcactattattaagttgtaaaaattagaattagattatgcatggaaagcatctatcacagtctggcatacagcagaggcacaataaatggaagatattgtcacaaggatagcaaggaggaaatgtttaatctgtaagcatttcaaagagggaagctaaaattgtatttctaagcagaaatttgtggacccattttaatgacaagataaaacacatttctagttagcagcattccttgtacataaacaatttatctacccaaggctagaaaacggtatgccctcaagtagattaaatcaaccctgccgggtacccccaatgcctctttactactcatttgtttggcaaatgctttcttctaagattgcagccaggtctgtgtcagctcagcgagggttcaggactaccggagtcagaaggagtgatcctggattcatcttacactgacttcctggctgacttagaaatggccataatgtagatatgttgaccaaagggtaccaactctccattataaggtgaatgaataagttctgaggatggtgactacagttagtaatatcatattatacacttgaaatttgtgaagcgattagatcttaattatactcacaccacatacacagacacccaaaatggtaaccaacagtcgtgaaagatgtgttaattaattcgatggtggtgatcatttcacagtctacacactcatcaaaacatcacattgtacaccttgaatacaaaccactttatttgtcagttaaacctcaataaagctggaaggaaaaaaacagtataccaaagaaatgaaaagatgggccaggtgcagtggctcacgcctgtaatcccagcactttgggaggctgagatgggtggatgacgaggtcaggagttcaagaccagcctggccaacctggtaaaaccccatctctactaaaaatacaaaattagcagggcatggggcgtggggcaggtgcctgtagtcccagctacttgagaggctcattgaaactctttgggctcagtttcttcatctggagaatgggaattctcatacctaacctacattatttttccattatttttccaagatgttcagaagtcaattgcataaaaaaccacctttcacaatgtagatgatcaataaatataaaagggagttctgcacgttattatttcaatacgaggtgggagtttagtgcagcaggctgcagctgtgtgtgcaataaatatagaattagaattttccacattgagtttctgaaaaactaaggagaacatgaactctggattcaagagagtcatactagctatacgatacaaggttaattgttctgattctcagctgcaaaatgaggataaataatcatggtgccacctatgatgttgtaaggacaagataaaagtaagtacatataaagcaccaagcatagtgcttggcccatgttaagagctcaataaaaagcattattttactataattatgatcatcattattatcattgctactcccctgccaggtttagcaggggtcctacctgtaccagctccaacataaagagccacaggacagtctggacagacaactgagatgctgtacgtcttggtcaggcccttgcacttctccagcctgtgcatgatgtcaccacttccccaaacttctccctctcacctccaagtttgtgctaaaccgcttaccaagcagcttcagactcattaacatctaatcagccctaattggctgcaattcagcagaagtcctttcagggggcaggtgactggcagaatccccagaagcaagcccacagcctttggagagcagtcactgggtgggtgggagagggaagaccacagctgggtcccctaagcagcctgtaccttcccagctctaaggcagccatgagacctaggtagtgaatgaatggactggtcaatgacggctctattcaacacatatttattgaacatctatgttgtgtcagactctgccctcctggaatccctcctggatggccctgtgaggggaatctactattgttcccattttatagcagaggaaaatgacgcccagaaaggtgaagggcttgcccaatatcccagcagctggtaagtgttggagccagaattctcacctcagcagtctaccgcagactccaagctcttcgccactcagtgaactgtgatacattcccccagttaccaatggtagactttgaaaaaggaaataaaaaaggaagctgaaatccacattgacagcaaagataggcaggaggggattgacaggagcggaagcaagccctttctcaggagatgatgcataatgatgagaaatagccagccaagggagggaatgaggggaagagcattccaggtggaaagaaaagcatatgcaaatgccccaaagcaggggagaccttggggttgtctcccctgtcaggggagacagggtcagtggggctggagcaaatgaggaggctgccaaagtcaatgtccatcaagcccgttcaggacactctgagtgaccttaggctgcattctgccccatctgcctaacttctcttctcagtggactctctgcccccagtgatggggatcatcatgctgtgttaccttgggcaagtcgcttcacctctctgagcctcagttttctcattagtaaaatgagagtaatggtcataatacctatctcataatacctcatacagaacaccttgctgttcctccatgtcccaccttgacacctctagaaatctcttccctctgtctagaatgtctttccctatccccttcacctgtggaggttttactgtgattatgaggcacacatcaaaataccacagcatccaacatatagcaggtgcttgataaatatgtgttgaataagtgaatacaaactccctagcagaatagaatgcaagccttgatttccagctcagccttacacacacatacacatgcatgcacagagtcacacacatgcatatgtgcatgcacatattcacacacacacgcacacacgcaagcacgcacatacgtgtaccatcccagccacacagaacatcttgctgttcctccatgtcccaccttgacatgtctacaaatctcttccttctgtctagaatgtcttccccatctccttcacctgtggaggtttagcctcgctttaaagtccagcactgatgctagtttcattttcctctacatccctacaacatttcataaacaaaaataaaacatacatcagtgctgcaccatagtctatttcccaccctctcttccctcacctcagactgagtgcttccccatagcaggtcttattcttctctccagtctgaacacttagcacacagttgacattttgaggatgataaataagtatttagtgactgaatgagtgaatgaataccttggaactgtttttccataaatatatattcccacagttctcttcctatcagtcaatgaacaaccacttaataagaccccgtttcttttgagtattatgccagctctttgggagaaaaatgccaacaatgacactgttctcaagaactgaaaatgtggtctaagaacggcaccactagaaagtactacacatgcataatcagtatgactaccacacctggtattccaatgtctaccagggataaactgctcagtttgtagattaacacaggaatctaaaggagaaaatcctactaatcagggggatatagcttaactttcttgcttaaacaacccgagatgatcagccagacttcccaagcctgtaaaaagagggctctaccaatgagaaattaaccacctggtattgagatggtagattccgactgagtccactcaggctgatcttagaccgagttggcaacaaacaaaaagagggccacagctgcccccaatgttcagctgcattcccaagctagagaacgagacacttccaaatctgaaataactcatccaactgaggcagggctctataaacaacagacaagtaaaatacattgaataaatattacataatctattttctttagtggttgtgtctgtatatatgtgggtacattcaggtgtggtttttacaatgacccttcgaagtgggtattataattacaactttatatgtgagaaaactaaggtttaagatttgattagtaacctggcacaaatcttaaaaccagtaagagaacacatcaggattcgaacaccaatatgagcccattttctactcttactgctgatgtgagtactaagtcctcattaactggtgatgaaagaaatagatgtgaaggaattaaaacaccaaaaagagccttggtatttcctctcatcttggttcaataacctcttgtgagaaaaaagttttcagtgcgtgtcgctataaatgagcatgattggcttgccagttgaacctacaaacagaaataatgtgagaggtcacaagtccactcatttgcactggacttccaaagagttttgtcatgcagtgtctcagttaatcccccaatagcccagggaggtggacatgggcaccattttacatacagagaaaacatcccaaaacattgcagtgatgacacatatttattaagcataaaccttaggccaggtacatcacacattatgccatttaatccaccccataaactgtcattgtgcctcttgttcagaagaacaggttggggcttagagaggttaaatgactcatccgaggtcatatagcttgtcctcagagccagaattcgaatccaaagacatgttcttaagaaccatggcattcacctctccctaggacacacaagggctcaaatcgagcccatgaggcttctatcagctatctaccagttcatttggatttttggctcattgcagactaatgatgcacaagtggtctcattaatggtatgcatgtttgtttgtttgtttgtttgagacggagcctcgctctgtcacccaggctggagtgcagtggcaccatcttggctcactgcagcctccacctcctgggtcaagcaattcttctgcctcagcctcctgagtagctgggattacaggtgtgtgccaccacacccagctaattttatttttagtagagatggggtttcaccatgttagccaagctggtctcaaactcccaacctcatgatccacccgtcttggcctcccaaagtgctggaattacaggcgtgagccaacgtgcccagccaatgtcacgcacagttttaagcaaaactatgtttcagtctcagctaaactatgtcattaccacgtcttctctgtctcccattgccgcttagagatcacaagatatgccaagatgggtctggcttttagagactctcattttgcagacccattcaagccatggatttagtgtagtgtcaagatgagaagcctaaacaacatagagaaagcccacgttcagccataacttcccactcactcctcactgaagaggtaggcacaatagctttctcactgcttagcaattatatcaagtaagagctgttggatggcatgagagaccacaagtagacacagaatggctatttggttggctggctgctcattttttgagcaaataaaataagcactaaattcaaaacagagcctcccacaaaataatccaaaatttaaatgaattttttaaaaaaagcatagttgaaatggagataagtcatggaagagtcagagaggagagaaaagaagagggaagggaggaagagggaagagaggatgatggagagaggaatcgagagatgagaggagatggagaggaaaagagaggaggaaagaagagaggaatgagtaaagaagaaaattgaaagaggtggcagagagatgggaggggctaagaagactggagattactaatggtgcagctgaatcataaaactatcatgcttataggaaactcgtggctctggggtttaacgaaaggttttatatttttaatttgccagatcagggacgcagcagggtcttttttttttttttttttttttttttgagatggggtcttgttttgtcatccaggctggagtgcagtggtgtaattacaactcacagcagcctcgacctcctgggctcaggcatcctcctgcctcagccttccaagtagctgggactataggcctatgccaccacatctgactattttttcttttttttggagggacagggtctccctgtgttccccaggctggtcttgaactcctaggcttaagtgatcctcctgcctcggcctccctaagtgctggaattataggcgtgaatcaccatgcctgacacagcagaacctttgagatatatttaagcaaggaggctggaataccacctcatttgactccagggaaaatataactttttcccagagatgaaaataaagacaccagagcggggtccactcaaggatactgatgtgagccatcccctgcctccctatatcggctggcagagacaggcaggctaggggatgcaaaatctcatgggtagagatgcagccttgcttcagagaaatcttactgcaaaccctggaggccagactttagacaggattgcaatgaccttatgtatccgaggcagtggaagtttcctctaaagaaaaaatgggaggcaagtggcttgaggaagtcaggcacagcgagcttcgtagccagggtcctggagccaacctcaaggcagcctctttgactcacacaatactgtctggctacatcatcactgttctcagcccaaccttcctcctggccatagaatctctgtatgctcactacagaaaaaaataaaaaaatatctagagcatgaggacacagaaaggacttccagaatcccccacccagtggcaaccactttgacacatgactgcttggagattgagagccaaattcaaatcccaacttaggttctcactaattggatgagttggggcaagtcacgtcaccttcctaagcctcagtttgctcctctgtataacaagagtaataaaaagtagcttcctcatggtattattgtgaaaaataaaataaaatgcttggtgcactgtccagcatgtacagggaatctattgctattatttattattgttactaacagcattagatgcatttcctttctctgcatcttgaaggtagtctatgcaaagtacccagcatagcctgtaggatatctccaggccattagagagagaaaaaagaaagtccttcctaaatttaaacttcatatcacttcgccctctgatttaagcagggcattaggttcatctctaactctccctttctgtcaactgaagaacatggatctgctccattcactgcacagtcaagctggggggcactgcagagaacaaggaaagaagaccaccaccagcagacatgggccatggcagctcttaacaatggccccaggaaagcctagtagctccactcagtgagaaacacgccaaacaagaaccaggtctgcttttctctcacttcctcccaccccaaaacaatgcagaacttgaaatcaggtgctttcagattcaggtgaacgaacctcaggaagaactgcacttccagtcccctctctttctcaatcacagaaacgatcaagttctctcctattccacctgcctgttctcaagtggaccctcccgtgaagatggctctatttcaaatcaaaaccccatcgcaccaccacccaagggcttccttttgcctttccctaatccactttttgcctagtgcttattatcagctgacacattaaatatttgttatgtttctgttggcctctcctcacacaaagaagacaggtttgttgactgctgtatctccagcatgcacagcccattgaaggctcaagtagcatttgttacatgagaaaataagttgtttatagccctccccaacacctagcatccacataaagtgtaagggatcttataaaggagttgcccatattacagatgaggaaactgaggctcagagagaacagacttttccaagctctcacagcaaagtttagcatctcagctatcaagacaacccaagtattaacgttagaatatagtgaatgtccccccctgccagtgctccaaggaacgttcatcctgccttgtttcagaagcaacatccacagccacagcgtcataggagcctggctgcccatcctgggtctgcatttactagctgagtgaggttggtgtgtctctcagtgattccatctagccatatgcaaaataagatgacaaatcctgctcttactaccttccagtgctgctctggacatcgatggaatattttggaaacatccttggcttctgatgatggaaggggaacccagtgagacatgaggagtcctcgctggtgagtgctggagttggtgagctttcagcatgggctggcctggtgcctctgcgacttcccatccacaagctgtccctacccttactcgtcacaagcaaggcaatgttgatgcagtaaaggactaaaccagagatgatgctgcacccaccaaccaagtgcttcctctgccctgcgtgctcctcctctctcctccctcgtccaaggcattccgaaaagcacccttgtcttttgggcagagttccctttccaccctcgagctgtccccactgccttagcctggactaatctctccagggaacctctcctacatccacctggcttctcacagaacagtgcgggaggttggggacttattacaaagtgctctgaaggatgttgccgagtgcctctggtttttgtctagtcactgaaaatgccgacatcatccttgatcagtgacacatgttctacatatgccccacgccaggtctgtgttgagcagtaaataatatgtcacttactgcttgcagcaactctatgaggcaggaactgtgattgtgcccatttcaaagacgagcaacctgggacacacagagtgttttgttaaattcccccaagtttcacagtcagtaagtggcacagccatgattcaaatgcaggtatctggcatagtagggaaagagcatggtggtgatggctacaggtccaaaatgaatgtgtgctcccatttacacagtgtggcactgtcgctgggaggcagctgcccagccatggacacttcccagcacctctgcatctgggtgtagccatgtgactcgttcatccaacaggatgtgggccagagttttggagagataggacaccctttcttctctccttcctgcttcctggattttctggctgcttgcagaaaatcctaagttattagaagatggcagagccacaagatagtggagactgacttcttaaatccccacatgaagagaagctgcctgctgaccccaggaatacccaccattggaccatcaggttagcaaaaagtaagctttattgttaagccagaggtcagcaaacttttctgtaaagagctagagagtaaatattttgagctttgcaggccatgcagtctctctcacaatggctcaactctgttatcatagcataaaagcttccttagatgatctgtaaacaaatgggtgtggctgtgttccaataaaactttattcacaaaaacaaacaagggcccaaattgggctggagaaccacagcttgtcaaatcttgtgctaaggcattaaaattttgcaggaattatttgttattatagctaatgttaatcaagtaatataggaaagggggagtcctctttggtttccttcttagtctcctaataatccacaaccaaatgcagagggatctcactttcccaactctctcatttctccccagagctggagtggccctctttctgtccccactgaatccatttatctatggaaaattgggagagagagtctacaagaagagcactatacctccccaccccaattgcacacacttttttttttttcttttcagacagagtttcgctcttgttgcccaggctggagtgcaatggcacaatcttggctcaccgcaacctccgccttccaggttcaagggattctcctgcctcagcctcccaagtagctggaattacaggcatgcaccacccacacgtggcaaatttttgtatttttagcagagagggtttctccatgttggtcaggctggcctcaaaccccttaggtcaggtgatcctcccgcctcggcctcccgaagtgctgggattagaggcgtaaaggctgcagtcacgtagactcaaaagaaaaacagtattttaaaaaaaagaacaagaatgctgtataaaacagtaaacagtaaaacataatgcagcaattaaaagttaatgccccaacatttattttggggatacggcatatgtctcacctagtctgggactaaaaagtttcctgccttattcatgcaggggcttcttcatggtttgcgtaaggcagccaattaaagtagaaactcagacctggcacaatgctcacgcctgtaatcccagcactttgggaggccgaagggggtgtagatcacctgaggtctggagttcgagaccagcctggccaacatggtaaaaccccgtctctactaaaaatacaaaaattagccaggtgtggtgctgcatgcctgtaatcccagctactcaggaggctgagacaggagaattgcttgaacccgggaggcagaggttgcagtgagctgagattgcactactgcactctagcctgggccacagagtgagactctgtctccaaaaaaataaataaataaataaaagtatatatatacaaaaagaaactcaatggaggctgcagcatcttcaaagtttatcactgattgtgtaaagcaagcacgggctatgtgcaagctgggctgcctatggacaggaagggatcattttcagaggcgtttcaaatcatcttcacgttcttgggtgattttttaaaaaaaaatcattaaatgttatacaactctcatttctctcgtccttcaatattactgcatttctctcatcattcaatattactgtcagttctggcagaaaatataatatacccctgctgagtttcctatgcccttctctgctccagatcatgttgtgtttgtatgaatagcatgtgcacaggtgagacactgcctccttggaagacaccaaaggcgtgtggctgctgtgtccagtcacgtgctcagacttcacccctgctatggggatgagggcaagggtattggttttggtctcctgcctgcacttactgttgccctgggggtgaagatgctacctgaaaacccacatatcctggaaaggtctcacacaaggatcaggcgttttcagacagaaaggttttcttgttgatgttttctactgcattctctcttaagctcaagactttttattttgtgttttttacattgatgagttataaaggggtctctctcatctttcccttctttttaccttcttctttgctgaatctctgctctctggccaggagtcattacatagaaacttaagtgcagggtgatcatctattaactcagcaaatagttatcgacagctacaatctcagatactatttaaggcttcagagatacagcagtgagcaaaattgctgtcaaagtgcccacattctagtggaaaaagcaataaatagatgtattatttgttgccctaaaaaagtgaaaagtgaagcttctttggtatgtctcatgcaccatctagggggtaggctctgccatactggctgctgacttgttaaaaatactactatcatgaggccagggagaaatctgaactcgggaaagtggtgtgggggccagaatttgagaagagaagaagcctacgctggaatcgcacttagttcacgtcacttcccagatctggcttccaatggcctcttctcaccctctaaataaaatacgtaaatcctcaatgtggcctttacaatctgcctcttttaatccttctctgcagccacaatgacttctatgatggtcttccaataccctgagcctgttcccacctcagggtctttgccattgctgtgctgccccctggaaagcccttcccccagatactcacatgggtgtcccttcacttcaaatgtcagcacaagaggtttttcctgcctaaatggcagccaatatgctctagtctctcgccctgcttttaagtatttcttcccagccacactgcttcctgccacattcattcacttgcttgtccatttgccgtctctgtccttatacagaaacgtcatctctctaaggcaggggctttgtcgtggtcagtgctgcgttcctggcacccagcagagagcccgtagacagtggtgcacaataattacccatggaatggtgaatgtttcttagcaactgtaacttactgcctgcactcctctcccctgcagccagttctccacgtggccaccagaggatgcttctggaaggtaaatctcatgttcaccaccatccaccctggctttaaaatctttagtggtttctttctgctcttatagcaaagatgcaacacccaaatgtggcctgagggtctcagcacggttctgctctgacctccttcactcttaccctccaagcaccagggtcttctcaggcaatttttttcagaccagacatttgctatgatccctccggccacagggcctatgcccagtctctttccacttcctgcaatgcttttcccttccctctgtcacccaccctagtcttcacatctcagtttcagcccatgtcctcagggaaccttctctgaccttcctgggtgggtcacacagtacttattacagcgcatcgtatttacttgcatgatacttttttgaaatatgtccctccttctctagactgtcagattcacatgagcagaaacagcacctggttttggaccccattttatgctgagcctagcatatagtaggctttcaagaaatccatgaacaaataactaaagagctgtgaccttcaaacaagctacttcaagcttgttgagccttgggtaacgatggctatgccagagagacatgggagacttcaatgacataaaatggatgatattttataaacaacaattggcgcacactgtacaaattaagtgattttttttaaatgtgggtctacccacctctaagcctttcatctaatttgataccttccacagagataccttgatctaaatgccacctctgctgagtttcttttagcgccttttgcattatgaaaagtcagtatctcattgaatcttctcatcaaaacagccagacatttaccatgtgttccaagtgctttatataaattaactttcagcccttgcaacccaccttcaaaggtaaatactatcattatccccatttcacagacgaggaactgaggcaccaaggaaaatgaaaactttccagtaggcacacccctagaaagtggtggattcagggttgaacgaacacagtttaatgccggtctccactctgagccattaaacaacagtggtggaacacacaccaaacaacaaatggggaaactgaggcccagagagctttcatcatagcttctgcctgactcccagctgcaactcctaacataagtctctgctcatgtgaaagagttcagtgtcctcacccaatggagagtttccttatcattgtccttaaccaatggagagtttcttgtgtccatatatccagtgtccttacccagtggagagtttctcgaacccatgactacaccatgcttttaagcacaccaggctcctaggataccacaggtgccccagctggtttgcacctgtgggcaaagtttgccctgcattcctgggcacgtgattatacctatattggggtgaatttctgtgactttcccagatgcatgtatctgacacccccacctaccaaccgtgaactgttataattccatcaacatttgccaagcaagattgtaccacatggaactctgcagtgagcagaggttacagagtgaggctttggccaaataggtctgggttcaaatcattcattcattcattttgttaacaaacactgtagagctttggctgtatgatgggcctgtgttaccaactcaggataccaaggtaaacccaggaaacacaggtgccgctatcagaaacccagagcctggaggggtagacagacactaaacacaacaacaagcaagaaaattggcaattgtgatacaagctacgatgaaaataaacaggatgatgtgatgaaacaaaactgagagtgaggggttagaacagggccatgatcttctccccatcaagctaaatgtgtttgggcaagtctcgtaatccctccaaacctgtttccaaatctgttcatggtgatggttaatctcaaggcacatataaaatgctcagaaatgaaagctatgcctttctggaacccaggcaccaggcattcaggtgtgaacaaagctatccatgcagtccgggaggggagccagagagaagcaagcatgtgcgaccagcattaaaggggcagctgcagtcagtcctctctggagccctgtccttgttcttcccaacacagccttgtgcgtatgctgatgctgcatgaaatccctgcttcttcatcgttcgtcacaagaggtaagttccccagctccatcccagcccagcagccaaccataggaaaggcagctgagaagtgccttccttctcctgccttcttgggtcattgagcaaagaggagacagaggcacacgggcccactctctcttctttttttcctatcaaccgggccaaacaaccagcaaggaacacctgctgaaaggtgaagaggacagagccttggcagagattaatgccttcctgatgccaggcggccgtgagaactgagattggcagtgtgaaggtccaccttctctgcaaccaaatcataagtgtcccatagacaaaggctttgtgtttatctgccttcagactggtcagtgatcagggaagcttagcaacttggggcaaaactggctcagggccgggcatggtggctcatgcctgtaatcctagcacttcgggaggctgaggaaggctgatcacttgagaccagaagtgcgagaccatcttggccaatatggtgaaaccctatctctactaaaaatccaaaaaattagccggaatgttagcacatgcctatagtccctgctactcgggaggctgaggcaggagaagtgcttgaacccaggaggcggaggttgcagtgagccaagatcgtgtcactgcaccccaggctggacgataagagtgagaccccacgtcaaaaaaaagcaaaaaaaaaaaaaaaaaaaaaaaaaaaaactggctcagaactgatggagccacactttgagaaggatgttgacttgctggctaatgaatgattaaggtcaagaggtaaaggtgtcactcatctttaatagtcccaggtggaagaaaactggtctatctattcaggagacttactggtccttggctttcttaaagattccccaaatctagagttctcctgacattggtgtgacccctccactcatctcaagaaccactaggactttgcattttcagaaagcatggttgactgtctgcattcagtgatttgttggctgagacagtcctaataggtcagctaatttgaatatcacacatatacccaaattacacattgatactttagcctacagtaatctttctaaaactcttcagcggcccccattaaatataaactcatcctggctcacaaatcctttacaacatgacaacatctttgacttcatcttcactttcttttaacgtgtttagagacagggtctcgttctgtcacccaggctggagtgcagtggcaccatcacaactcactacagccttgaactcttgggctccagtgaacctcctgcctcaacctcttgagtagctgggactacaggcacacgtcaccacacctggctaatttttgtattttttgtagagacagggtcttgctatattgctcactctggtcttaaatgtcaagactcaagtgatcctcctgccttggcctctcaaaatgctgagattacagatgtgagccaccactccccacccatcctcactgcccaccatgtgtctgtacttcctttctctcaccctcctctccatataccctccaaactgtactgctcctctgaagaagtctcacacatctatatctccctgcctctgctccatttcaaatgtccttccctggctcctttcaaagcccttacctatccctcaaggcacatctcatgtgtcacctcccctgtgaagctctgcctgacttctccagggtctcacagaccctaggccaggggctttcaaacttgagtgtgcatgggcatcacccactggagtcaccgaccaggagatctcaggggaagcccaagaatctgcattcccaagtgatgctgatgctgctggtccagggaccacactttgagaaccactgcactggatgatcgatttttttttttttttttttgagatagggtctcactctgtcacccaggctggagtgcagtggtatgatcttggctcactgcaaactctgcctcctgggttcaagcaattctcatacctcagccttcccagtagctaggactacaggtgcttgccaccatgcctggctaatttttgtatttttagcagagacggggtttcaccatgttggccaggctggtctcgaactcctgacctcaagtgatccgcctgcctgggcctcccaaagtggtgggattacaggcgtaagccaccatgcccagcacgattaatggatttctatggaatttaatttcctttctgcctactgctttcaggtaaaaacgatgaatgattcagattcccctgatgatctcacttgcataactgagatcaggggtttttctgaaattcaccaggacttctccccttttcaatcactttgtgtgattggtattagcattagttctctagaactgctgtggcaaagtactgcaaacttggtggcttgaacaatataatttttttctctcatagttctggaggctgaaagtgtaagatcaaggtgtcggtggttccctctggagtctctgaaggacaatctatttcatgcctttcttccagcttctggtagcctcaggcattccttggctcatagatggtgttctatttatgccataataaaaatattagtacttactttttttttttctttttttttttttttttttttttttttgagatggattctcactctgtcacccaggctggagtgcagtggcgcaatctcggctcattgcaaacgccattctcctgcctcatcctctggagtagctgggactacaggcacccgccacaacgcccggctaattttttttttttgtatttttagtagagatggcgtttcactgtgttagccaggatggtctccatctcctgacctcgtgatccgcccacctcggcctcccaaaatgctgggactacaggcgtgagccaccgtgcctggccagtattattttttttaagattgtatgcatcttcataccatctctcctctctgcatgtctgtttctgtgtccaattttcccctttttataaggacaccagtcttatcagattagggctcacactaatgacctccttttaacttgattacctctgtaaagaccctctctccaaataaggtcacatcctgaggtactgagggttaggacttcaacatatattttgttttggtgggggatacagcccatgatgccttgtcagatgacacctctgatcccaggaggatccatgccgtggagacaaacaactcattatttgccttgatgacctgtcatctcatagacacctccctggatggatggagcactggaatttgggctaccagagagttccgcctcggttagcagaagtaatttgcccgtgtccttatgcaacatgctgacctggtcggtcatttaaatgaaagggcacggcagccatgcaaaactctatctccctaatgcttttcttcccattgctttcttcttcttgaaatataaaaacgaccctgttgtataactgcattccattgcactgcattaactaaaccaattctaagttcttttgtggaaacatggtgatcacttctccgcttgcatgcactaacagcccgcatttgaagcctctccccgccgtgtgcagccctgccaccctccaccgcacccgacatgcattatccagagtgatcattctaaaaagtatattggactaagttacttaaaacctgcttaaaacactttaatgtttccccttccctaagataaagtctaaaccccttagcatgatattcaagggtcttcattcatctccatctgacagcttctctactcctatttcttttattattggtttttattttttagagacagggtcttgcactgtcacccaggctggtgtgcagcggagtgatcagagttcactgcagcctctacctcctggactcaggtgatcctcccacctcagcctcctgagtatctgagacaggcgcatgccaccacacccagctaatttttgtattacagtgacagggtcttgctatgttgcccaggctactctccaactcctggattcaagcaatcctcttgtctcagcctcccaaattgttgagattacaggcatgaatcattgtgcctggctctactcccatttctaagccctctcccacacccagcagtccttccagacaaacccagctgtctgcagctcctcccagtctacatcataatcccctggaatgcttttctgccttagtctgttcaggctgctgtaacaaaacacataaactgcgcgtaaaaacaacagactttatttctctcagttccagaggttgggaagtccaagatcaaggtgccagcatattcggtgtctggtgacggtcagcttcctggattacaggcactgccttctcactgtgtcctcacagtggaagggtctagagatttttgccttgcctggcttgccctaatcccattcatgacttaatcacctcccaaaggctccaccccacctcagcctatcactttggagatcaagatttcaacatatgaattctagggggacgctaacattcaaaccacagcacttttcctcctcttgtctagacctgtgtttcttaaccccagcactgcgaacatttggggctggataactctgcattggagggggctgtcctgcacacactgtaggttatttacaagcatccctgtcctccacctactagatgccagtagcaactccaccttatccccagtttggacaacagaaaaacctagatattgccggccaggcgcggtggctcacgcctgtaatcccagcactttgggaggccgaggcgggcagatcacgaggtcaggagatagagatcatcctggctaacatggtgaaaccctgtctctactataaaaaacacaaaaaaaattacccgggcatggcagcaggcgcctgtagtctcagctactagggtggctgaggcaggacaatcacgtgaacccaggaggcggagcttgcagtgagccgagatcgcgccactgcactccagcctgggcgacagaatgagactccttctcaaaaaaaaaacaaaaaacaaaacaaaacaaaaaaaacaaaaacccaccctagatattgccaaatgtcccctggcctagataattgcaactagtccttcaaaaatcagggcagtgtcacctcctccaggaagccccctggccccctcatcccccaaacagcagcaaattcactgcgtgtttactttagctctttcccacatcagactgaaaccaggtctgcttctattttgtgcccctgacgctagcacagtgcccgcccggcagggagcagacatcccctcccaccccccaatgtccccactgatgtctgttgatcaactagatgatagacagtgagtggaaaagaaaggcagaggggggacccactcttgttccttggtgccagggtttaaagaggtttggctgcatctagcgtgttttctcagatgctctcttgctcacgactcaaaggcgaatgcgaatgtgcattcgtagcgggggcagggatgaactgcactccaaacctgcaccaaaaacctgctctctatccccagggtctcaggtaaatgtggctttgtttaaaagcgcattctctggatcttctgttttcatttttaaactgtaaaagatagagttgtttgtttgaaaatcgagacgctaaactctaagtcttttgctgaagctcctctccctaggggcaggatgggagcaaggcttaccaaggctgccacctacagaacagagggcagcgaggactgcgcagcagcgggagggaccggtggcgttgggcgcggggagggtctgcgcggggagggtccgcacccgggagcgggggcggctgctcgctctactcctgggaggggcctttcgaaggaccaggtgctgggcagaagccccctccctccctcagcaatgaggagcctgagcaaatgtgcaagggagggagagggagggggagggggagggggagggggaggggggggagaaagagagagagagagagagagaggagtcctggtccacaccgctcagaggaggggtgcggcagccacacactcaccaggtacacactcgcaatccagcacactcacagcgcacatgcaaacacacacaacccacaaacagcacaacccacaaaaacacacaatacacctccacactgcacaaatacacaacacacacatccacacaccacacacaaatatactacacacatccacacaccaccataaatacactacacacatccacacaccacacacacaaatacactacacacatccacaccgcacacactacacacattcacaccacacatacacactcgcaacttcactcagtgcacatgcatacgcccacaaatacaccgaacacacacatccacatcatgcaaatacactacacacacattcacaccacacacacatccacaccacacacacagatacataaacacatccacgtcatgcacatccaaatacacaacacacatccacaccacacaaacatgcactcacaaccctggactcacaatgtacaaacacacaacacatacatccacaccacaaatacacccacaaacacaccaccacacacactcacaaatacatgaacacagtcacaaatataaatccacgccacacacaaatacatgaacacacattcacaccacacatccacaccacaaacacacatccacaccacataatgctgcacactcacagcagacatacaaacccacatattcacacacacacacacacaaaacacacatccacaccacattcacaactacgcacacataaatacacatagcatacacacacaaatacacacacactcacatgtgcacacacaaacctacacattcacaccacacatacacacaccataggcacactgcacacactcccatggagacacacccacgcaaccctcacgcagctgcgctccgacactgcatctgcctctgttcctgaataagccgctctggaggctggaggcagctgtgggggaggctggcaggtcagagctgtgccgatgagccgtcgtatctatgctctgcgaaagcggccccagccaggaacactcccctctgccgcaggctggaagaggtggctttctctgtgcttatcctaagcccttccttctctgcctccacctgacatcaaagccccctggcaaagtaacccaggttaaggcaccccctcacctccaatacacaggtggtggtctgagtgggtagagtgccagatgttaatcagcagcaattaatgtctttttactttaatgaatcttatcacctttatcataaaaaagtgaagggaatgtgtaagacttcacttcttccatgagaccttcccattttcgtaagctcatttttaccagctaattcttccaacaacccagcctacaaaaggtataacgcagagtaggaattccagggggaaagatgtgcaaagtaaatcttaataaattttgaatcatattttcaatgtattgggtggggtgtgggcttgataattaaggagaatcttctgtaaaggttcaataaaatgacaaattcttttgtaaagagattactcattctgctgtacctactccctgaagctaaattgttatataaaagccttactttgaacaagctagggaagttccttaaggcaaggtggtgtcccctcagttctttaaaacacaagtatctcttaggtaagggctctgagtggggcctcttcctagctacatggtctcacggggtcatttaatgtctccgggcttgtttcttcatctgtaaaatgggagtaatattgcctgtctcccagggatgcaataagagttaaagataatatatgttcagtgtctggtacagactaggtgctcaataattgctagctgataactttggtatgaccatgcttttgaccaacccagatacccatccttgagtgtataaatccaacctactccgctgagctcagttcaaagcccaccttctcagtgaagtctttccatgaatatgctaattggaagtaaaccacctccttctgcaatctgcagtcaccccctggtactttatttgttcctttccacattcagctttgtatatcgcaatatagtcccggtgcatcttacactccctttacaccataattagcaagactcatgtctgagtcctccttgtgcaatgattgcacacagtaggggctccataaatgttccttaggtgattaatagcaatagtgtggtagaccttgtaggtggctccaaaaaaagcactccaccccctgaccaccagataacaatggaatttctgttgtaccacacataaggtagttttaaaatatgtctgcaaatttttcaatactcccctccttcaaaaggtaaagcttaatcctccctgtgtgcttggcaactctcttctcatgaatggagtgggggacaaaagacagtgtgatttctgagatgacatcaacaaaggcaatgtggttgccttctctcttttggatcactcactctgaggaagttggctgccatgacatgagggacttcaagcagccccacggagaggttctcaaaatcaataaatgaggccccctgccagcagcctcggaaacaagccatccatgccagccagtcctccagcctcagtccagcctttagatcactgcacctctggccaatgtactgaccacagcctcacaagagaccctaggcaagaatcccccaactaagttgctcccgaatatgatccacataatcagtaagataataaatgcttgttgcttcaaacttctaagttttgggatgatttgttatgcaccaatagctaactaatacacaacacagccatcagtacatagttctgatgctgacccaatcccggacaatgatatattaagaggaatctgctggggttgggatggaggcggcatggggaaacatttactaactcacacctaagggggccataggaagataaaatctctcttctgccacatttgtgtctgtatgcaatgcctcaaacttcaggaacccttttggaaccagcctatgagtagactcaacactaaggatggtagaacagacggaagggaagaaggtggattcttgttgataccactgggccactgaatccatcagtccccaactttgatctacgtcagagtttctggtcatgtgaaataataagtttatacatcgtataatctactttgagtcaaggttctcataattacttgcagctaaacataccccaactcattcaaggagctacttgtaatgggctctctgcattttacatttggtagtatcttagacactttttacagattctttctaatctctctagtatcctacaatttagatattatcacccctactttacagatgaggaaactgaggcttgatgccgttaagtaacttttcctaggtcacatagctagtgagaggcaccgctaggattcagtacaggcctttgaactcaaagttgacattcgttccaacccaccaggctgatgatcaaagtggcacgctaagaaagcaccccaggatttgctcagaaaggcagccgggatcacatcagcagcaagcccaaactttaaatgctcactcgctacctccttatctttttgtggagctaaacattatcctctgccatgatgccttccaaagcaggacaggtcttgatgtgattttccacttctcactatatatggtattgtttctcagtatcctacaaagatgccaccaactttcaattatctcagctagggaagcttctgcaaccattctagcccacagtcaaggctccctgctctgaacccccactgtactgataaccagaaccacacagcttagtgctgaagggttttcaaattgtttcaagcatcttaacctgcccccatcagccaagctacctccttcttaaggtcaaactcctgtgccaaatactccttttgttcagcccctgagcctagatattacagcatttgatgcttaatatacacttgcccactgcttgatcaatggaagggggctgcaatatacatatacatacacacacatatatatatacacacatatatatacacgtataaatatgtgtgtatatatacacacatatatatgtatatatatacacacacacatatatatatacacatacgtgtgtgtgtgtgtgtgtatatatatatatatagagagagagagagagagagagagacagagacagagacagagacagagacagagagtgcctcactctgtagcccaggcaggaatacggtggcgcaatctcggctcactgcaacctctgcctcccaggtcccggttcaagcaattctcccgcctccgtctcgccaccatgcccagctaatttttgtatttttagtaaatatggggtttcacaatgttggccaggctggtcttgaagtcctgacctcgtgatccacccacctcggcctcccaaagtgctgggattacgggtgtgagccaccacacctggcctgcaatattttttcacacccggcctacaatatcatttttaaaatcatgtgtacatggctttttgctgcacagaaaagtttgacttgcctgccctcctttatgctttttctttcctctgttgatgtctttgctgagtccttatgaagtctttcctaatgccactccctaactcccaaattaagtcattcttcatctaggctgtcattgtgttctatacatatctttaatatacatcctattgctttatgattatttgcttttgaaaagtttttagacaatcagatgtgttaaaaattccctaagcaccaatgtctggttcatactagatgctcaataaatgttatgaaagggatgcacacgtttatcattcaaaggatagcctacgtctgctgtgttcctacaacagttatgacagctctcatcccacgacattccaatcatgtgttcgaatctgattcctcttttagactgtaagttaccaagggcaagaaattgattttttcaccattcttatctctaacataaatcacagggtacaaggcgagcattcaaatatttgtagataaatgtgtgacaactgtgatctatttagtcaagggttaaatgtgttactattccctaatcaatgaccagggaattattgagcaattcaaagacactgcttttgaataaaacatttaccgtacattatcacctggcaaagaaaaaaaacctgtgcctgttcaaaatattcttttgaaaatgtttgatggggaggatctttagttgatgtcataggcttcttcaagttggtgacagttccttgccaattggccgaagtcttccttggtgccttccatcaccagggtgcagacatgattcaaggatttctggtaagatctggccaggaaaatgtatcccacgagctcaaaactgccaagcactattgttaataacacagatggcctccttcaggaaagtattattttctttccctaaatagaagcaaggtaaatatgttcttccttcttatgtttaccaagggtctctggctggtttacatccttttgtacagcaggctctctctcaggcctcttgcaaattttttttttttgcactggctcccgaatgttctgctcctaagactccgaatctgcactgctctggctacgtgagagagaggttcaaagtgggacacagcttcaccatcagttaatcctgactgatcttctgccagaggtgacaacctatcctcggggtttggcagtgagcctgatgaagataagaaatgccagactgggtcagaccaatggcccattctggccatggcactgtctgacagaggcatccagaaacgttttgcagaaaagagctgtatttgtctcctatgacatcagtcatcaaaaatgtgcaaagtcctcctgaagcagatcatcttggggtgccccacccaacttccatgccacccttttccaagctgatggagtcctcattttgttcaagtgcttacttgcctacaggaggctcaggattaaatctcttttgccctatgccagggtttctcaacctctgcactactgaccagatcgtgtttctttgctgggtgggctgtcctgtacattgtaagatattttacagcatccctggtccctacatgctgatattagtagcatctcccgacaaacacctacctgtgaacaccaaaaatatcgccagactattacccttcggggagggaaagacaaaattgtccccagttgaaaaccactgctctaagccaatatgatagccccattgccttagccagtgatggttttaggggtgagcacgtgatccagttctgaccaatgtggcatgagaggaagtcatattgaggccttttgagaaatgttctctcactcttaagaagctacaaaactgaaagtgtctctttctggttgctggcatatctagatcacatcttatcaccaccctgaggatgcagccaataaaaaaggatgaaatacatttttaaattgtttttttttttttcttaaagccatggctcctcagttaacctaagcaactttagggtcaccataccttaagactcttcactacataataaatgaaattcatttcattactgacggcataaatttgagttggggttttgttacttgcagccaaaagcatcccaatataaacaccttcccatcttttccataacaaacctactttgcttctctcgcttattagtagtcaaaacatcacctttcaatgcatcccaatgccgtataggatggtttaaagagccctggagtctgaggcaaacagctaagtttgagcagcagctacacacacacacacagctcttaatttccttcatttcttccatgttgataacaccataaattctgcacccttttgagattgtgtaatggtcaaatgagatagtgtgtatgaaaatgcataataaactccaagtgctttgtgggtatcattacattttcagtccctaccacccccttcagagggtggcacgtctacatattcaccacccaacactcagacttcagctaacgtttattaagcctaactatatgttaagtgctgtgtatatcagttgctctaccttagtgctgttgacagttggagctggttaattctgtgtggaaggaagctgttctgtgcactgtaggatgtgtagaagcacccctggactctaccctccagatgccagtagtactcaccttcactcatgacaaccaaagctgtctccacacattgccaaacagagaacatttgtccctgaaggataaaattacttcacattgaaaaccattggtgtacaccctggtgacatacagataaaaagatttgtttcctgccctcaagtaatttatatccttctataaatgatcatttattttataacataaaacaaccacaaccattatttggtagcagatagatctaggtcccactctccgctagcttgtggatgttactgtctcgatctcagtttcttcatccagaaaatcggggtgataaagtctacctctctagatcattttcagaattcagtaaaataaggactgcaaaacacctaacaaagtgcctggcaaacaattagtacccaataaatgttagctttgcatactattgtgttcttggtttaaagattattgtctgcttttaggaattaggacctcagttcctgttaatcttctttactttgttctatgaacttacagacttgagtcccatacctgatatagatgttggtgctccacctgaactgcctcagatcttcttaccatttctgcaaagccaccctgaatcccaatagccagcaccttcatctttgtaggagagaaacccctctgaatattggaccccacattgccagcatgcatggtgggtcagaagtgtctgagagttaatatatccttttctgccctggaatagcctttgaaagatgactaatgggcacaggagtataaatacctcagctcctccactccttggcaggaataattctcaggtgtgcattttacattgatctcagagcttacctgcagggttaactttcagttcaccaccttggtatctggcttactaacatatgtctcactggtgggctccctctccttttatcacctcctgtctcccctgcctgtgacccccctacatgtcccagataaactaggtacattcaatatttaatcacaatctgtttctgagggacccaactaaaacactatccctttactttaatgattaagagttcagactcaatagttatatttcctgattagaatcccttttcaaacatgtattaattttgtagccatgggcaagttatttcacctatgactcagttttctttatgtaaaatgcagataataatactcacttcacaaggttattataagggctaaatgagttaatatttgtctaatacttaaaatcgtgattggcacttagtaagccctatgtaagcaattattccttttaattccttcgtaatcaatcctagtctccttggcagccagagtcaagtttctaggacttgggagaactgcctactacctcaagccaacatatcaggaattatttaagaatctaattttcaaaaacagtcaacagcaaaaagaaaacttctatttgcccaaaggataattccagactttgttagtgaagacatatgtggggacatgttgcctgcaaactgcttggattcctccacttgaattaacattcaggaaatatgcctgaataagtctgcatttgctcaataatctctcctggcctgggaagaagactagagatattagtgtctccaaacactaacatagcccaggtctgtgccctccagaaatgagcattcctcgggctgttgaatggctaagcagtattccattctgaaagacagtaataccccacacttggcctcccttgggctggtgccacaggggctcaaaatgtctcaacccataaaagacttctctccccatttcctctctccatctcaaccttggagggtttctgttcctaatgctattctacatggcagctgggatcagtgcaagctccagggccaagttctacaagcctccttcctgctgacgtggaggaaggagccgagggagagatctctctggccccagcccctgcccattcatgcatcagaaacttgctgtctctattctaagctatttacctcccagtcgttgctattccaaaagagagccagaggggaggaaaatctataacagtattttaatttcctgatatgacacactccatactgaaattacccttccaaagatcagagttccgcttggcaaaagcccagtgaatttcaatgaatgataccacccagaaagaacagagttttgttttatggatggtgagatgacaatgaagagatggattgcctatttatttaaatttatttttaatttacatttaaatgctctgtgtttactctatctcaggcactgtgctaagcattttagactcattatctcaaatgctaccttctcaagttgtcacagcattaccaccttatttattgattttttactatttttttttttcgagacagagtcttgctctgttgaccaggttggagtgcagtggtgcgatctcggctcactgtaacctccgcctcccaggttcaagcgattctcctgcctcagcctcctgagtagctggggttacaagcacccacaactacgcccacctaattttttgtatttttagtagagacagggtttcaccatgttgcccaggctggtctcgaactcctgacatcaggtgatccacccgccttggcctcccaaagtgctgggattacaggcatgagtcaccgcgaccagcccacaacttgcctgggactccgcagtcctcttccctcctgatttttttccattatacttagcaccctccaatacattatataatgaattgtttgtctgtctctcctgattaagatggaagctctataatggcagaacattttgtgcaatttttttgtgagcagtgcccagctcataggaagctttcaattaatatttgctgactgaaaggatgaataaatgaatctcctggaatctttctgataacccagtggaaaagccactgttatcatcactcccatatttatactcatacccataccatcctacctgataggaagaataaaggtctcccaatagatgtctatgtcccgataccaagaacctgtgaatatgttaacttacatggccgagaagacttcacagaagtgattgaggatcttgatatggggagattatcctgaagtccctggtttggcccaatgtaatcagaagtattcttctaagagggaggtagaaagggcagagggagacaaggacttgaagatgctacacttctagccttgaagatgaaggaagaagccaggagccaaggaacaaatacaggtgacctctggagtagggatccccaaaccccaagccacggaccagtaccagtccatgacctattaggaactgggccacacagcaggaggtgagcggcaggtgagcaagtgaagctttatctgtatttatagctgctccccattgcttgcattaccacctgagctccacctcctgtcagataagtggcagcattagaatctcataggagcaccaaccctattgtgaactgcacatacgagggatctagatggcatgctccttatgagaatctaatgcctgttgatctatcactacctcccatcaaccccagatgggaccatctagttgcaggaaaacaagttcagggctcccactgattctacattatgatgagttgtatcattatttcattatatattataatgtaataatagaaataaagtacacaataaatggaatgcacttgaatcattccaaaaccatcagcccaaccccggtctgtggaaaaactgtcttccacgaaactggtccctggtgccaaaaagattgaggaccactgctgtagagacagtgaatcataatctgagagtttacagaggagcacagccctgctttcacaaaccttgattttaacccagtgaaacccattttggacttcagtcctccaaaacatataatttatataataaatatgtgccactttaagctaagaagttcatggtaatttgttatggcagcaataggaaagtaagagacccattattcagatgatgaagctaagactcgagagcatgtcccaggccccccatgtagttaggtggtaggatgatgtagatgtaagtgcagtcagcttaactccacactcttcctcttgtcctctgtacaaagtcaagggagttgatcaaacaataagaaacactgtgtgcaacactcagttcctgggattttggtgctataaggtcatgactattccaccctgcaatctcttcagcacccactctgtactttgggactgtttttcctctccatggaattctaagctcaaataactgcagtcagttgtaaaagtgcacagacaggaacaagacacctcctgcatgggtctcagagtctgatggaaagggcagtcgtaagtgagtagtaataaaacattgggaagaaaaactccatgggtgcagggcattgccttttcacaggagtatccccagagccaagatcaatggctgactcatagtaggcacttaataaatatttgttgagtgaatgaatgagtagtaactcaaagtagtttttaaagtgctccaagtatacaaagctggaaggaattaattctgccttgcatgtgtgtgtctgagggggtgtatcagggactggaccattcgaattgaatattgccgaattcacacaacttggcaaagagaaagggtattccagggagagagaactgcatgtacaagagcaaggaggtagaaaataccaggaacggtcaccagagcatgccagggtgagtgcaatactgtgcaggtggtacagaagatggggcagagagactggccagaccctgccttctctgccaggctggcctgctcctgtcagccacaggagccagctcagacatttaagcagaagggtaatgggattaggtaggtattttgtaaagactacacttgcactgttacgtgggcaccataacaatgcattttcatttgtcagatcactgtcacatactaaaaagtcttgtttgtgctgagagatctcaaactacctcttttactgaagacttcaagggggaaactacagaattataatggcctggaaggaaatgtctctgaaagacaaggatagtggccagtagacaatggcacacatgcccaaaacattgtcatcaggaaattcaagaggtcattaaattctactgtaggaggaaattaacacaaagatgatcccaatgacagatgtattctcatgataattcaagctcttctccatctggaataagagaaaaacaaatgactttccaaagagctgatcacatttaatcttcctttaaagacctgtgggttggatgtgctatcatcacttcacagttaaggagactgagccccgtgggccagttttgcagagctggtgtttgaacttgggcagctacaaagcctgtgctccttcccatgctcaccctaagtccttttacatatcatgcactgaacttccaacaggaacggtcaagtccccaagacctaggccctgtccttaaggaatcgccatctgccccaggggacatgaatgatgcttctagccagggagaggggtgggctaagatattccgccttcaggttgctgggagggtaagtgtgaccagggctggctggcggtaaagacctcccggaaaatgtaggtcctgtgctggatataaagaaaagatctgttgaggcaggaagcttcaatcactagagcaaattccacccaaactgggagcttctcctaaatggagatcctgagccctatccttagaatacagagagtgaggccaggcatggtggcttacacctgtaatcccagcactttggaaggccaaggtgggcagatcacctgagatcaagagttcgagtccagcctggccaacatggtgaaacctcatctctactaaaaatacaacaattacccaggcacagtggcacactcctgtagtcccaggtactctggaggctgaggcaggagaatggcttgatcctgggagacagaggttgcagtgagcagagatcacgccattgcactccagcctgggcaacagagcaagactccatctcaaaaaaaaaaaaaaaatacagacagtgagtctgagtaaaacttgggaatctgaactttgaacaagccccactagtaattctgccactgttcagggccacaacagtgaatggagaagagtaggatggagacagaaagcttttaactgaaactttccaaattcagcaagaaaatcaaatgactgagacagaagatttctgtagttgactagcagaggatcctatggaaaaggtggtttgatctacaggaccttaaatgtcaggctaaaaggaagataatatattttgttgaacatctaccacagatcagaatctaatcttgtctattcttcacaacaaccctctatgaatattcccactttaaattacccaaagtcagccagctagcaagagaagagctggagcttaaacctgaaatgtgtgcctctctgaagcccataattattccactacacaccgtctctcttaaggactgtgagtgacgaatgaagcagagtcactggtatcttttgagcaggtggtgacaagttcataggagttttaggagggcaaatgttgcactaaggtggattgccctggggagaaaatggagccaggattagaccactttgcctagtctacatcctgccacctgctgttacaacgtccttctgttgtcagggtcactcatgaaatgcagtaaaagagctgtattagttggtgcaaaagtaatcgtggtttgtaatggcaagaaccgcaaatacttttgcaccaatctaatacatccataaatggatatatttgaatatggaatgacaataagaagttaaaatttaattttaaaaaactgaacagaataaagaaacaaagccaaagaaaggaaaagatcctacgtggataaagcagaaacctccacacaagagctgtattattagttggtgcaaaagtaatcgtggtttgtaatggcaaggaccacaaatacttttgcaccaatctaatacatccataaatggatatatttgaatatggagtgacaataagaagttaaaatttaattttaaaaaaccgaacagaataaagaaacaaagctaaaaaaaggaaaatatcctacgtggataaagcagaaaccaaaagtaaaccaagcgaaaaaaaagaagccaaataaaactataagctgatcttcagaggaaaaacattaaatgaatcttctgacatgactgttcaagaaaaacaaaccaaagaaaagaaaacccaaatggccaataaatgtgaaaatatgttcaacttcttaataagataaatgcaaattgaagaccatggttagattccgttttacatctatcatataagcaaaaatgaacaggactaatacaaagatttaaagagatataagaaggttgcaacttttcattccttgctgtgggaacataaacaggctcaatccttttgcagaacaaattggcaatctctggtgatgttgaagatgcccacatcctatgacccagaaattttacttacaggcatatatcattaagaaaatttctcatctgtgcaaagatgttctgtgtttcgttgatttaatgacaaagtgcccatcattcagttcatggataagtaaaatttttatacatccatagggtggatatttaaaatataaatagttaaaataaatccactaaagctacatttataaacacagataaatctcaataacataatactgagtaaaaaagagtaatttgggccaggcgcagtggcttacgcctgtaagcctaccattttgggaggccgaggtgggcggatcatgaggtcaggagatcaagaccatcctggctaatatggtaaaaccccatctctactaagaacacaaaaaattagccggacatggtggcacgcgtctgtagtcccaactactcaggaagctggaggcaggagaatcgcttgaacccaggaggcggaggttgcagtgagctgagatcacgccattgcactccagcccaggcaacagagcgagactctatctcaaaaaaaaaaaaaaaaaaaaaaaaaaaaaaaaaaaaaagaaaaaagaaagaaagaaagaaaaaagaaaaaaaaaacagtagttggaaaaatatagtactgtttataaaaagcataaaacatactaataccattataccctaggtttgcatgtacatatagaaaaacacatttatcagctttaggttagtggtttcctctgaggaaggagataagggaatgaaatgagggtggcaggcttcagcagcatctttatatttttaaaatctgaaataaatgtgacaaaaatattaacatttgttaaatctgaattgtcagtacatggttgtttgttattttattctctgtacttatcagcatgtctgaaatattccaccattgataaatcctggttttgaaagagaaaaagaaaagatttaaacacaataataggatgacttctctgagactccttagttcactgcagatatccagatcaatgtaaaaaggatactctgagcagacaaaacatctgggaagacctttgtcacatctgatgaagtgaatccatctggcaccaagctgcaaactccctattaacagtgcactggcaaactcagtcacttcaatagacaacatcagaataggtgcttttaaattcaactaagcccttccttaggcaaataagataaaagcttcaacagaaaccaatgtagcccaaatttaggatcacccacgctacatttacccatccaatctgaaacaataaaagcaattgtgcctgtctgaggcatatttttctgccatcaggtttaaaatgttaaataaataataattgaaatatgaaatagtggtgtctatacatgtacatttttgtcactccctaaacagcaggaattatacccaacatttaagttctttctcagggtttcactaagcatactccaggctagagacagctccaggctggatattgcaccaaatgaattcacacatacactccctcacccactagaagttcatatccctggacagctggtagcagtcattccagttaacagcatttctgaatgcagagaaaaccaggcaacaaatacttaatgagcatttcctaaatgcagtgtcatactaataacagagaagataaatacatgtaccagaatttctactctgaagaaattaataatataattgattcacccatacatatatccaagcaaccaaccattcatccctccacccatttaccctttcactcatccacctttccacccttgatccattcaaccctacatctttccactcatccattcaaataatcattcacccttctctttatacaacaactcctttaccaatccatcctcttccccttccagccaggctggtcctcccttcccattctacacctacccattaagccaccttccattgcttcatacatccatctcttcaaccctctaaccacctgtattgggttgagcagcatccttcaaaaattcatgctcactcagaacctaataatatgaccatatttgaaaagaaggcctttgtagatgttatcaactaaattaatatgaggtcatactgaatttggaccccagtccaatgactggtgtcctgaagaggagaaaacacaggaacacacacaaggagaaggccacataaatatggaaacagagactagaatgatgtacctacaagccaaagaacgccaagggttgatggcaaccaccagaagttagaagatgcaggggagggtcttcccttagcatccttggaaagagaacagtaatgccagaaccttgattttgaacatctagcctctagaactgtgatataataaattcctgtggttttgagccacgaagtttgcaggactttgttgagcagccctaggaaactaatacaccacctcccctaccaactactccatctctccaacccccagccagtaatcttctcaactatacaaccctccacccctccagccttctacccatccatccctccacccatccatccagccatccacccaattccccattcattccatccaaccatgcatccatctatccacccatccatccatcattcatccattcacacatactttatttagggtctatgtgccaagtgttgttctgtgtgctaagtgtacaatggcgacaacagtagtagcacgatattatgggttcttcctctgacatatgctaataaccccactaatatcaccagacctcaagaataaatacaatctaagtaaatacaatgggcttgctatgcaaactgaacttcaaggtaagttccctaggtattcctgccacttgtaactatgttggtggcacttaggcccttccaatataaatgttctggggcctccactagatgaggagcaaaatatccaaggcctcttcccaaatggatatatagacaataaataaatcatacaagtaaatatatatttatcaattttgttgaattctatgaaggaaaaaaatacagctctacaaagaaaataacaagggtgcaggggacagggcactaattatgattagggagtaacagaaagcctctgtaaggtggaaaaacaaaacaaactcataagtagttaaaaaaaaaaaatcacttcccaaagaggcttacacgatcagggaagtattgggctttgggtaagtgctacacactctcagaggacagggagtccactgaagactgcaaagctttcttgaagaaaagtctgcctggatactgaaggataaatgacagttaagtaatgggagggatacctatttttagcgtggtcctcaataaacaaaagcgcagacatcactcgttcattttaagagatcttgacttttatgtgccaacgaccactttggcaggctggtgaagccttcaaattccttctcagaacagagctgtcaaataagtaaaataaaatacgtggccgggtgtggtggctcatgcctgtaatcccaacactctgggaagccaaggagggtggatcactcgaggtcaggagtttgagacaagcctgaccaacgtgttgaaaccctgtctctactaaaaatacaaaaatcagctgggcgtggtggtgcagacctgtaattctagttacttgggaggctgaggcgggagaattgcttgaacccgggaggcagaggttgcagtgagccatgatcaagccttgcactccagcctggtgaaaagagctagacactgtctcaaaaaaaaccaaaaaacaaaaaaaccaaaaaacaaaaaaacaaaaaacaaaaaacaaagaaacaaaaaaaccgctagattacaaagaaaacaaattatatcaaaatacagtcataatgatgttttaaaacaaacttgtgttatgtttatgtcggtattaacatgctaaatcacaagatctgtgctgtgtctactaactacaatgatttcaaaataatttggcaaaagtaaataattctgaaatatctacaacaatgataatgtgataagaaatatgtaatttctcttggtgaaaaaaaatcagacagctgctattactgtgatttcttgctacaattcaaaatgaaaagaatgaaaacttttgttagaggtaagtaaaaataagcaatttttccccatccaagtttacagaccactgagttccatccacagaccccttaggggcccgtttatgtgatttatatgtttaggtatttatgtatttgtccattcatttactcgctcattcatcccccaaattctgaatgtttctgacattcctgacaatatggttagtgctagcaatatacaaggccaaaaagacagatgtggtgtcttccctaatgagcttatattctagtgggcagagacagtcaataagcagataaacaagatagttataggctgtgataacaatagattgtgaaaaagaatcaacagagtgatatggggaaaggggaggttcacctggtgttggtacccatgatgaacacattatgcagcaggatggggaatcataatacatggaagagggattcagacaaaggccctgtaacaggagaagaacttgggcatcagaagaacaggaggacagtccatgttgctggagtgaacatagcaataggagacagaggaaatggcgacaaagatggagcagctgcagatgtgctgggccccacagactatgggaataggttttagttgtgccttaagtgcagtgggtagccatggaagcagtgtatgcaggggaataacagatctacattatattgttttaaaagatttctttggacactgaatagagaatggattgtaaagaaaaagataattgatagaagagaccagtttagaggccattgcattcatccaagtaagagagtggtgacttgatccagggctggggctactgaggcatctacgggtacagaattcaaggaagaactcattctcagggccatgcaagtgcaggattcagctacccctggctttgactggtggtagaaatgggtaggttgatgatatattttggaggtaaaatcaaatttgttctaaaaatttctgaagttcagaagcaaataataactttagaaaggagcccatgcctcagacaacagagcgtcttaaacaacagaggaaggacttttgactttctcctgtagctaatgaagggccatggaactaaagaaataaaatcacaccatcgtgaccgaaaaaaaaaaaaaaaaacaaacaagatttttagagggtggtgagaggtaagaggtaagtgaagagaatgtttgggcattatgtgtttatacaattttagattcgtgaatgagttaagacccagtcagggaaacggaaaccactccaggtgtttccaacagagataatacaggaaattggttacataggagccactgggacacagagagaaaaggaaaagaggaagccattaatatcctagggatggaggaaaagggggatgcaggagacattaccaaagttcagaagctgggtcgcttggcagtagcaaatcccacagcagggaccacctgataggaattgggaccctggaggctgcccatcaagagctagatggggacattcccaaggaagaggaagtgagggagaaatcacctatagcctggataaaatatgtccttgcatatagaacagagaagggaaaggtcagagaaaggattgagaacaatcaggctaccggagcagacccgggaacaaagtcctcacagcccaatcctctatactagaaagagaaggaaaatcaataggtactaggcacgaaccacatgccggggtctgtgcttcacgttttctgatgttgcctcagttctgtcccacacattatctgtttagcccctactgtgacctatcttatagataagaaaattaaggctcagcaagattcagaaacctacttagggttcctccgctagccagtggctaagctggcacctaaacctatgtctggaggaacccaaaatttatagtctttcctctgatatccattgttcttcaaagaggattatctgctgttcattaaatgctaactgcatgctaaaaactgttcctagtgcttgatcttcaatgtatcatttgttcctgcaagaaagtcatgattacttttagcaccatcttcattatcatcatctttgctactattattattttcaacttacagatgaggaaattgagactcagaaaagttaaatatcttgccccaagtcacaaagctagtaaatggcagattcaaagccagggatatctaatgaaagctgcgtttcctctttacgagtgcaagctatatggccttccattcataacacacccacaacagtgcaagccaaaaaccatccccaaatctaacttcctaccatattgatcaaagtattcattctgaaagacatcagagcagaaactgctggtttcccacccaatgtcggttctccttttcctttttagaactccagtttaattcagaaacaatgtttctaggtaaaatattctattccccagccttcctccctatcagagatgaccaacaatagactgaaatgctggggtaggatttctgagctcttgaagaaggggcatacagctagagtgtgccctttttgctcttctcctccttattcttgtttcctgctttgagtgtgaatgtgatgcctggagctccagcagccatcttggatcatgaagcaactttaatgatgcaaaccatgtgcttaagagtacaacagaaatacaggaagaggcttaatctatgaggacaccatgaagccaccttggcaaccctcaaccacctacctccaggctgctttaatctgagaaggaaataaacttctcttttgttttagcatttccaggcttatttattggcaaacacaattcctaaccaatatatgcacctgcccgaatactaaaatccaatgaatagagattcctgagattcctttacatactcatttccactcattcactctgatttaaatacagtcaactgtgtgtctcactttgattgatggggtgccatcaaaagcaaaattttctcccttgttgcttctgaaaaagactcccaaacccacagtgaagtcagtctggggcagagagaggtggtgtgatattatatatgtcattataaactctaagtgcctcttttccgaactcttagaaggttagtagtggcaaaggcaacaaaaaagtcacagtgatgaatagaacatgttggaaagtggctcagagagtaggaattaaagaatgccagctccagtaaatgtcacatatcaatcaaaagtgaagaaagggagttccctccaaaagtggcagaggggacaccttcataaacagaacataaaggccaatcgaactcagcagcaaaatgggacgtattcagccagagcctgtcactttgtacaatggcaacaaaccattccgtcagcttctctgctgaaatcagagaagtactaaaagggatttttgaaaccatttgctcagtgcctccattacataggggaggcaactgaggatcagatagggtaatggccggaccaaagtcacataaaaaatgaatggctgaactgggatgagatggaaacccaggtccggtacttgctgacttctccactgatgtacataccttctttatggattgcgagtatccacttctacctaaggcaggagttgataagctttctctgtaaaaggtcaaataggaaacacttcagattacaactactcacccctgctgttgtagtaaaaagcagccctagacagtagaaaacaaaaaaagtatggctgcattccaataaaaatttatgtacaaaaatagctagctggatttgacctgtaggctgtagatggccatgccctgacctatgtcactgggttcaactggtcaccagaccaacagcatccagacctttctagaaatgcaaattgtcagtctctttgcctccagacctaatgaaacaaactccagaaataacattcggaaatctgttttcacaagctttccaggtgactgacacacactaaagtttgaaaaacattgggttaacacgccgggcacagtggctcacacctgtaatcccctgtaaacccaacattttgggaggccgaggtgggtgtatcacctgaggtcaggagtttgagatcaacctggccaacatggcaaaactccatctctactaaaaacacaaaaattagttgcgtgtgatggcatatgtctataatcccggctactcgggaggcagtggtagaagaattgcttgaacctgggaggcagaggttgctgtgagcagagattgtgccactgcactccagcctgggtgacagagcaagactctgtttcaaaaaaaaaaaaagaagaagaaaagaaaaacattgggttagcaaaaagacacatgcactcatatgttcgctgcagcactattcacaataacgaagacatggaatcaacctaggtgcccatcagtggtggattggataaagaaaatttggcacatatataccatggaatatacacagccataaaaaagaacaaaatcatgttatttgccgcaacatggatggagctggaggacattatcctaagcaaattaacacaggaacagaaaaacaaatacttcatgttctcacttataagtgagagctaaacactgggtatacatggatataaaaatgggaatagacactggggatgatgataagtgtgaggagagcaaggctgaaaaactacctgttgtgaactatgctcactacttggatgatgggaccattcatatcctcagcatcacagaatatacccatgaaacaacccagcacatgtatccactggatctaaaataaaagttgaaattataatttaaaaatgggttagaatcatagcaaatcactgtgcatgagccccgcctagccatttctagtacataacctggtatttggcttctagtagatgcttatgacagcaaccataagcctcccacccaaaaatctattctctccttctttaacatgagaaggaaataaaattcttacttaagccattgataatctggattttctgtcataaaccaccaaactgaatccaattgatttagtatcccgtgaatatttgttgaatgaataaataattctcaagcaaatcagaggatctaaattacatgttacaggtaggtttgattagtacagaaccactgcttcaatatacttttatcagtagataaaatcctcctaaaaacagtgtccataggagtcaaaataataaaaaagaacactaggtggtgaaaatattggaaacttctagacgtacagtagccttcatttcttgcaccgccaaaagccgggctgataatggagcaaataccctcttcccaggctcccctgaggaagctgccactttattcatgaccccacagtcaccgtctcctggaagcctttcctaattagagcccttctagaattctgggattttatgtctcagcagtatggtgagaacaataggattgttctgttctgctttattcgaatcatactgatgtgtcatttttcaatgatccttaagttactctcaaacagagagcttttcttacccatggtaggttctcaatcgatgtctatagaattgaactgactttgttggtgagtgttttgtttcttccacgagaacagatattccttcagaatcaggggctgactcttctatttttcaaacaacccccaaaactagccacagcaacatgcaggggccctgcatcaacaggtacttgaatgctggtaaatgcgtcccaggcacctcacttcgttcgcccattttggtgcatcagaacaacgttgtcactggtctaacctcatcttcactccctggggactgaggtcttgcctgattcccaaagccctgcaccagagatcctcaaacattttcaactaggactttatcaacgggaaaaagatggacagcttcactccatgttaacccagcgactccatcaaacctatgcttgtttctactgttcatgcctctacattgatgtttctcaagcttttatgatccaggtctccttgataaacatttttaacctcacattttcctctaatgctatttgaaatggcaagagaaattaatatggtgactaaaacatatcaagagatgtcatagttcaatagaccctgctactaacaaccccaggtgcaaatctttgcttcacatgctattctctgactcttacttgcatagtctgttttgacttctccatgtgcttcagtgaaatgcaaattactgtttgatcccatggactagactatggggaaatctccattgtttcagggcaagattgatattcagctggttgtttatggctggcaagcattcacacggtcagtgcattcatccaaacggacgaatccccatgcctcatcaattgttacactttttcaatgtcacctacctaagaaaatcagaatacaccgtaacgtggagaatccatatgcagataaatgaaagaggagagtcaggaccatgcaaaaaattacagggaaatttagcaaagtctggtgataacatagactctccacacagcattcaacacaaacagaaaattaatctctgatgcaattgggcattcatacatgccagtaagttctgtactttattttaaggtacctcgcctgcctggcatcagttgggagaattattaaccatcattaaatgattaactgtcactaaaatggtagcctgctgccacccagccaagagcatgctgtgtggagttactcacgtgagaaaaaacttgttagcaaaagaatgcacctgcaacccagagcatctactcttgtgacattctatttcggcctccttgttacaaccacgattttctttctctatctagcacaatacatatgccacaggagtctctcaacttcaggttaattacacccatctctctaaggtcagatcttcagaattcatcctttcataaagttgttttaatgcatgtttaaatctctgtcatttgctcactgtgtgacttcaggcaagttattgaacctcaattttcttatctctaaaatagggctaatcatagctcctacctcataaggtttttaaaagaattcagtgacagcatggatgaagggcatctagcatagttcttgacttgtagcgtgtgctcagtagtgttaataattatggaagagctcattggccaccaagtgaatgctaagctggaagaggattggatacattatttactccaaccccatctcaagccaagactataaccctctcaatttcatgggaggttgaccctctgtcatgacattggacaaacattgggagggggggcgcttaacatggtttggtcattcctcccacggtctcagggtgatagatactgggtggaaacatgggtctcttacgaatagagagctgaaagtcacctacccataccttaaagagtgttccttgagagagggctttcggaaatggatttagacatcatgaatccaacaactaagagatcatttatctgtcctcctgacacttccatagtccatctcacccccagcacatcttaggaactgactagaaatattcttcagactttagaaagcagacgatgctcttcatcacggcagaatttcatatcccccggtgttggagtgggaggctgccagcctttgaagtttgggatgcgtcttcctctctgtgcctctcaggggcctttacttctgctacactgcacatctggggagggttgcctgaacactagctcacgaagtggccgctgggctccttcctggagtctaatcctgtctgtctcatcgtgtccttctggaaacatcaccaacttatttatctctgtcataaaaggagaggaggaaggagcagcagagagtttcaaggttaaccaatgtttgcagagtaaaaatggtacctgaagacagatgtatgctgcaaaatagcagttccatacaaatgcaagagggcgtcaaagtcaacagggacaaaactatgggctatttcatgttcctcactgagtaagacctcactcacaatcacttattctgattataaaaatgatgacctacaaagagacccatgtttccacccaggatctatcactctgagaccttaggatgagtgactgaagcatcttaagctgcccctcccagtgtttgctaaatgtcatggcagagggttaacctcccaggagattgagaaggttaaatgagataccacgtgtgcagaggccagcatggtgcccagctcagcagtaggcacttgggaaatgtcacctttaacactgatatgtaagaccagcccatcatagcagcattattcacaatagccaaaggtgggaacaacccaaatgtccattgacagaagaacaggtaaacaaaatgtaaatacatacaattaaatattagccagcgttcaaaaacaaaggacattcggatacatgctacaccagcacactccctagctcacgatattttaagtggatgaataaatgaatgagcaaaaaaagagcaccctacctctaactggatcccccagctgtgaactctctcacattttttctctagcaaattccctcttttttgctgtttctttctcctcttttctgttctattctctttcttcatcccctatgctttaaaagacacttgcatctggggctttttctgaagccgttttttccctcatttttttctgtccacaaaacagcaggaaataatttgctttaaatccacataaaatacccacgaaaaattcacactccatctctgaatgaggaggctaggtttttccaacggtggagccacaaaagtctgttttgacaagttatctccccgtaaacatactggtttatctcatgctgaacaattagatgtgctatttaggcaaaataaaaaatatattgcacattttctagacagcctgttagcatccatgccaatgacacgaacatcaggacatggggctgatattaaagtaaccagaaacacaaatgtgtattgcaacactcggaacattgccatctgtgtgttgcatgcccggagggacacccagggaggactgcgtgaagacagggtgagaaagagtccaggagaaaaacagcagctgagaggagtggggtgggcagggattggagtagaagcagatgggaggctgagattacccacaggctaagccagtggttctatactggggacacattcccacccccaccccaagggacattggcaatgtctggatgcatgagggttgtcataaattgggcagggggtgctactagcatggcatgggtagaggctacatgtcctgcaatgcgtattatatccaccccctccaccccacagcaaagaatgatgtggtcccaaatgtcatgatgccaaagctaaaacaactccaggctaagatgaagcagagtacagatcagctctgctactcagtggctgtggaacttgggcaggttaattaaactctctaggctacaagatggctgaaagccatctgtgggatagatgagatgagatggcagatgtgcaatgcacatagcagctgtttccatgaatgctaatcccttttatgctctccttgtggtcctctgctttcccaaagcgtatttatttactaattcactcagttctttaaccaacatgtattgagtgtctactctgagcctggagctgggtgctggatattcaacaacagataagaaaggcagagaccctgtactagtctgttcttgcattgctataaagaaatacctcagactgggtaatttataaagaaaagacgtttaattggctcacagttctgcaggctttacaggaaacatggtactggcatctgcctggcttctggggaggcctcaggaagcttacagtcatggtggaaggtgaagggggagcaggcacatcacatggccagagcaggagagagtaagtcttggggggaagtgctatacacttttaaatgaccagatctcaaagtaactcggagcaagagttcactcagtaccaagagtgtggcccaagccattcacaagggatccacctccatgatccaaacacttcccaccaggccccacctccaacactggagattacaattcaacgtaagatttgggcaagacatccaaaccttatcaattcccccatggatcatctaatgtattgggagaggcagataatagataatgtacaaaccaaactaaggttagtgccatgagagtaaaggacagaggccagagactaacacccaatctagggtgatcagggaatctgtctctggggaagcgacattgaagcagagacctgaaggatggcagagttttggggattggtgctggttccagacagagagaaccaaatacacaaagactctaagaaggaaagaaaacagggtatgttcaaaactgacagagagcacaggtgacaactgacagagcacaggtgcgtggtggggagcaggtggcaagaggagagggataagacaggtgggtaaggaccccgcagttcatgagaaggcacctaggttctagccaccaagatgtcatgagaagcccttaaaggctattcagaagagaagtgacctgatccaatttaccctggctgcaaaggaaaggatgaagtaggggaggagtagaggtagaagcagggagaccagtggaggctgcttcatctacagctccagatggtgatgatggtggtagcactggagatgaggaaggatctgagatatacatttgaaggagaataattatacattgcactagactctggtggggatgagagaaagagaatgttccaccattcactgggtggtcaggctgggcagccaaggttaaaaggctaagtgtcatccagggaagagaccatcacacgatttgaggttgctgagaacagacaacacacacaccaggctcaagtggtagagcaagaggagacagactacacaagatgcagtcccttgcaatgcgtcagtcccccacagccagtggatctgctctgcagtcaacccaggcagtgcagctgcacacacccacctcgtgctgcagtagaaggacccagatccctttccaccagggacagatatagtagcaggtttggccaggggccattagatgcacacacttgagcagaacaaagtacatcaagcccagaacagggaaagatatttccaggcaaagagatatgcccagcccaggctgggagggctcttcatctcttgttaaggaaatgtttcaggcccaaggccactcatacagccatacagggtccagcaagctgtgcatgaccacctttcccaatgcagtgaaggatagatcccacgtcttgggcttaggcagttaggtggatggtgagtgcaattactaaagagagaaagacctgggaaggaacagttaagggtggggagcaagaggaagacaatcaagaaatgctcagtacctgtgggttccctcttgcctatccacccctccctcctacttctgtttctctaagctcaatgacaatgttccccactccagcagctctagaattcattcatacctgggacttcagtggcaacgtctgctcttctctacctgagtggtagccaggaagtctgagtcttcatcctcaactcggggaagtcctggagcccttccctggacatgggtccccgagatgccagcaatgttttctaggtgccccaggtgctcctgcaccacctcgaagcacctccatttaggcctcctgactttgtttaccaagcacgcctctagcctcgctactcacagtggggtccatgggccagcagcatcagcatctcccaggagcttcttagaagtgcagagtctcaggctccagcccagacttgctgaactggaatctgcattttaaccaaatcccaggtgatttgtgcatgcgtgttaaagtttgagaatcactggtccacagctcagaagccagccatctacaacattgccatatgtcagttatttgtaattacagttaaaaaaaaatgctaccagcgtggcctgggatgatttgttcttaaacttcaagggctgcttgaagcccgagatcctagtgacactgagatatttataaggtttcccttcgtattctctgagcactcctctcatcatcagattttccagatgataagtttttagcaggcccttcttccccctctactcctgtgtggacctctgggctgcctttttcaggttttgcaaactggctatgaattgttcagcggttggattagccagttctgcagactgcctcacacgcagaccatctggaccgcttatagagaagacatgttccaagtaccctctttcctttgtctgcttttctcatgggtactttgccctctaagaagcctactttcctcttttcctctcctcctctccctatttctctttgttgagagagcagtcagattaacccaacaactcttggagtgccttggtcacctgagagcatggaaagtccatgccctcaccagagtaatgactaccatttctccaaaactctcctcatgccatccgataggcagtattgatcagaaggggaaatctagtgtgttaaaattgataaaccagcttaagtaatacctacataaaagaaccatgcctagcacatggctgaatgttgaatactgttgcatggaaatttgggatttctagttagaggctttataaaggtagaatcatgcagacacatatacctggaaatattcggaacattctattagcagaaatgcaatgtaggaagcttattggttctagaagaatgtgtcattgtcagtaattggaattactgacagatccagttgaagtaaggggaaaaccacaaagagtctgtactcttaaaactgcaataatagagtcaaggagtcttacgggacgagccatgaatcttgttaagaatttgggcatgtatctcttctggttgtcctgattatgtaagtcccttcttcaccctaataacactgtattgagaaaaacttcaagtgcattatgcccccaggatgaagctataccttgttaacaaaagctgtgcctatagaaagggattggagtggagtttgggaaggcattgtatagaggacaaatgatgagtctcaccagacagggctcaggtggtaaatgaaagggatgtactgagcctgtactcttgagagcattttgggcacagtacctggctgctgcttctatcaccagtatggtcccaagcaccagccctgcctgccactatcacttcttgaaaggcaacccaagaggagaagtggacgggagccgacaccaggcaggggttaaattgtttatatgcatcatcttgtttaatttttaagacaaccctataggtacagtacttttgtttatctccatttcacagagaaggaaatggaggcacagaaaggtgggtaggttgcccacctaagtgatagagctaaaattcaaaccaggcagcctgattccaaagcccacactcttggccactacataaaagattcttcaccagaatgaccttggtaccataggttcatgatcagaaagtgatgatacctctatctggggacttggaaacatccatagctccttcaatgagcccaggacaatctttcaccatcgtgagagtgagcaaagatgtctcaagtgatgccctttgtggttaagcatcatgaggctgttgcattccctgctggtagggaaattggaggtacgtgcacattccatcccttgcaattctgtaccttccatttgcagcatgagaataaacaacaagttgaaatgtgtttataagagtgaagcatcaacttccaaatccagctgacctgtgtgggttaaaggacttagcaaagagaaacaagtacctacaattttatggctccgatgcctctcagctttggctgcaatttggaagtacccaaggagctttaaaaactactgaagctggggtcccatgccctgagtttctgttttgatttgtctgcactgtgccctaggatggagggaagttgtaaagttctcctaggtgattatagtatgcagtcaagtttgagaaccactggacttagcctctcttgggatctcagaataagtttgggtgggtaggcttctagaataaggcagtgcctctaaagacgtggtctgtggaccccctgacatcagaatcacctgggaatctgcttaaacatgtgcatcctaggctctatccctaaatttagattcagtatttctggggaatatcccaggaatccacatatttaacaagttatctgggtgattgtctgtgctcactgaagtttgggacactagagaatagagagtagtcaaagcctatggctggttttcattatggtggagaagcagaaggaaaaatgtgctcagaggcagaggcaagatgaggaaactcagtgacaagaccccctttttttttttttttttttttgagacagagtctcttttcgttgcccaggcccaggctggagtacagtggcccaagctcggcttactgcaacctcctcctccctagttcaagagattcccctccctcagcctcccaagtagctgggattacaggcacccaccgccacgtctggctagtttttgtattgttagtagagatggggtttcaccatgttggccaagctggtctcaaactcctgacctcaaatgattcacttgccttggcctaccaaaatgctgggattacaggtgtgagccaccgtgcccagtcaagatcccgtaattcttgagcattcctgaaacctagggaaagatggaaagtgcttgcaggcaaggcccatggaagacagaaaaatcatttatagactgcagtctctaaagacacaggagtgttttaccacatgctgatatcacgcagggttggtctggggaagggattctgaagccaggggaggtagttttggccactgaagtcctggctcaatggaatcacttcttccctctcagcctgacaaagcaaagtgggctagtcccatcttccttacctccaaaaccagtacagcattaagaaattcctaatctaccgtgatgtgtgagggtcaaaaaagtgggcctagaggtgaaaaatggatcatagacaaaatattagacatccttcaccctttgtcaaaattaaaaacttttattcatcaaagggcactattaagaagtgaaaatacgaccagcctggccaacatggtgaaaccgcatctctactaaaaatccagaaaaaaaaaaaaaattagccgggcaacagtagcacgtgcctgtaatcccagctactcaggaggctgaggcaggagaatcacttgagcctgggaggcggaggttgcagtgagtgagctgagatcgtgccactgcactccaatctgtgtgacagagtgagacccccgtcacaaaaaaaaaaaaaacgaagtgaaaacacgacacacagaaaatatttgcaaattatatatctcataaaagtctagtatccagggtacatagagaacactcacaactcaacaatagaaaggcgactccgtttttaaaaaaggcaaagggtctcaatagacatttcttacaagatggcatacaaacagccactaagcacataaaaatatgctcaatacaaacagtgattagagaaatgcaaatcaaaatcacaatcagatagcacttcacactcaccaggatggctaaattcagaagaatggaaataacaaatgttgaccaggatgtggagaaataagaaaccccgtacactgattgtgagaatgtaaaatggtacagctgctatggaaaacagtacgacagttcttcaaaaagctacacatagaactcctatatgatccagcaattccatttctaggtatgtatatacccaagagaactgaaaacagatgttcaaacaataacttgtatgtaagtgttcatagcagcattactgatagcagccaaaaactggaaacaatctaaacatcctacaatcaatgaagggataaacaagatatgatatggccattcaatggaatgttatacacccataaaaaggaatgaagtactgataccttctacaacatggatgggcattgaagacattatgctaagtgaaggaaaccagacgcaaaaggccatgtattatacaattccatttacatgaaatttccagaataggcaaatccatagagacaaaaagtagatccatggtttctagggctggggacaaagggagacagagtgacggctaaaaatatgaggtttctttttgtggttttggaactgttctagaattagggagtggtgatggttgcacaatatagtcaatatactaaaaagcattggactgtgaactttaacatgataaattttatgtgaattatatctcaaaaacatttaaacgtaagactaggtatcacttattgaccaatttctccttgctggcctaagtgctattatacatagataaaatttctggctcaatccttcaaagaatcctccaatgaaggagtttccattattatcaaaggacagcccagtgtaggcattgagaatgtggttctgacgccaggccacatgggttaaaatctcagccctgaacttgctgggactttgcatgggtcctctcctatgcagtttcctcatctgcatgtcggggaatataatggtatccagtacctggcgcgtagtcagcacctagtaaattttggttgatcacttaaaggtcctcctccctccttccctttcatcctgagtttgagagtttcacagtcatactaaatcagattaggaaactgagccctagagaaatgacgtgacttgtctaaagtcccgtatcacaaaaagataaatttgtatgcctctacttatatgggatacctaaaataggcaaatttatagagacagaaagtagaatagtagttaccagggaccaagcagcggggcggaatggagagtgattgcaagtaagtacagagactcgatttggaacgatggaaaagttctggagatggatactgatgatgattgcacaacaatgtgaatgtacttaacgccactgaacttaaaaatggttagaatagtaaattttaggttatatatattctaccacaataaaaaggaaccagtccatcaaaatgagtgtcatccaggacagtcaccctacagggcaccttgatgacacatatcaaagtcttaaaaataagccctttgactaacacattctgtactaggaatttctcataagaaaataatcagacaagtgttagaaggacattcatctcgtcaatatctaaaataatgcctctagctgctctaaatatccaaaatagagaattaaatataattaatatgctaaaaaattaaaaattaaaaaataaaatcctacaactagtgtttataactctgggctctgaacccagacagagggactccagaaattcccttagccactatgcttctagacagtgagaaaatccaaaccactccctttttcaatgcaaggaagttcattccgagacccatctgcaagagtgaaaaatgcgcccattgtgctacctgtaaaaagcatggcaaaatgtgaatgttccttaggatcggacatagggctaaccagaccattctcccagcccagcacctgggacatcaggaagcaaagtgggttgaggatcccatccccataggccttcctctgagtcactggtgcaaagtctgtcctgctgcttgtgtttgtttaccctctttcctgcattaggtacagctaagctttgcaaattaactcacaacaggatccagtgggccttgacccaaaaaccatccacaggagaatgttgacgaggcaacaactgctgcatccatcccacaaaacccctagccacaatgccaagtttgtatccagagtggcgacggtggggacctaaaagctaaaacaagagctcagcagggttagggtctgccatgaactcttaccaggcaaggcagggtggagacacatgtccgtggccctcccacgcactaggatctgtatgatgctcctcatctaagagatgagtttggtttaaatttgaactcaaactgtattcttgtcacagacaatccagagcactctctggggtgtggctctgagacacacaaggaggaaaagacccaagttctacctcaagcagctcatagtctggaggagaaagagctatgacgactgaacaaatgcagaaagtaaatatggaagagtcgagagcactgtgaacattccatctgcagctacctacacttctgaaaagccagactcaaacatcaaagtctctccttgcatctccaccaggatatgtgtgtagtaggcagagcactggtccccaacaaggtccacaccctaattcctggaacctgtgagcatgttaccttacacagcaaaggggacttggcaaatgtgattcagttaaagatcttcagaggggaatttatcctggatgacctgcgtggggccaatatcatcaccagggtcacaagtgcagaacctttcctggctttgggtagaaagagatgtgacttcagaagaaaggcacagaggaatgcaatgttgctggcactggagatggaggaagcgaccacaagccaaagggtacaggcagcctctaaaagctggaaagcccagtaaatggattctcccctgcagcctccagaaagaacacagcactgcaccttgattttagcccagtgagatgtgggtgaccagtaggattataaattgatgtgctttaagccactgtgtgtaatttgttatagcagcaaagggaaaaaatactaataggatgtgtaacaggcatctcaagtctatcatccatctcagccacattagcccctgacttcgttgctgaggccaaacattttggtggcatctccaactctcctctttctctcattctgcacaaatccatcagtaaacccagtacatcccacactctcaccactgccactacaagtttggtccatgccacctctcacctggatgacttctgtttccacctgtgccctcttacaatccagtatcaacagtgaagccagaatggccccattagtccatgtttattatctgccccaaaccctgcaatggtgtttcaggcaagaccttgcacagtcctacaaggccctttagagtttggcctccggttacctttctgccctcatctccttccatccccaagccagcttggcctcttaaatgcttctgaaacacactggaaaacacccccacctcagggcctttgcatatgctattttctctccttggaatgctcttctgcgtagcccactccctttgaagcctctttagggtctttatccaaataccattttttttggtgataccttccgtggcatcatatttaagactgcagccttatctctgacgtttcttgtctccaaggtaaactcaggcctggatcagacagctctgcttttagccatccacgtgaaccaggataaggtatttctctctctaagcctctttttcctcatctgcaaaatgcggttgtggtaagggctgaataccattgtggtgatggttccacaggtatatgcctacatcagcactcatccagctgtgcggtttattgcatgtcaatgcctcaataaagctgttaaattagaaaatgttagtaataataatgacaacaacaataatgaagtgcttagtccacggattgaaacatcttcataacatgtgagacactgttgctctgtggtccagtgtgatgaacaaacaccacagagctttaccagccaagtgcctggaaccgtgctggggaaatgacagcctcgtctgttcctcgtgaccacactctcggtgggtataatgcccacttcacaggtggacaaagtgagactcaggagccacacatgtagaatgttctagaacacagaaagtcctctttccagcatgtccttgtggcagattaggcaagacaaggggggaaaagcagagtccaggggggaggcaaattgagatgcaggagggaaggagataagagcaatagggaatcctcagagcacctggcaggcccccagcccctgggggcaggagaagccaggccacgtagtcatgtccccatggagaatgcagctgctcctctgtgctctgccctcggttgctactgccctgcgaggcaacctcgaggctgggaatctcctcctttctctgtctgcagcagctgcagtgaaacaaagggcacagcccccttcaggccaagagaggtgagaagctgctggggagctgatgtcaccactaccccctccgaagcccatccatggggcacagtgcactccactggcagatcccggaaagggagcatgctgactgactggctgactgactgcctgccacatcaccgtctctgcattgcaattgcaaacactgttgtgcattctgaatccccagtgtctttctgtttttcaccagccatgatcatgacagtgacaacaataacaatacagccttatgctcatagctccattcattcaaacagccatgcaacaacacctgagatttgttgtgcatctgtgaggactgaaggtccgagctccttcctccaaccacccataccacactcactgaggactcactaggtgtcaggcaccatcttagcacaaataagatacacaaggcctgtgcctttgggagcttaatttctagtagggactggaggagaggggcatatggataataacaaccaaaaaaaatggtaatgtcacagtatgataaaggctgtgaaagaaataaagtgcaagctagagaataataggagagaactgactgggtagtcagggaaggcctcttaaggagttggcctttaaggggagacctgaagaatgagatggagacaatgcagccatgtttcaggcagaggaaaacgctaagcccatggggtaggcactatggtctgaatgtctgtatccctccaaaattcagatgttaaaacctaatcctcaatgtgatggtgttaggaggtagggcccttgggaggtgattaggtcatgagggccaagccctcataaatgatattcatgccctgataaaagaggctccagagagatcaacggccccttccattaccaatgaagaacaaaacaaaatgatgacagccatctatgaaaaaggaagcaggccctcaccagacatgaatcttctggtgccttgaccctggacttaagcagcctacagaactataagaaatagatgtttgttgcttacaagctacccagtttatgacattttgctatagcagcccaaacagactaagaaagcaggaaagagcttggcacaggctgggaagaagtgacagaaagaaggttgctatgataacgcaatggtgtaatcagtgtgatttttatgtgtttgtatcagagaaccctgggtgcaattcctgtatgaagaattgcatgagcactttgtatgagaatgagcaagttaccctctgtgcaatgctgctctcagcgagcaaataagaatgatcatggaactgaattgatggcacttttgtgcatattaatcaaattgattcatgtaaagtacttaatacaccacatacagtaagtgcttaataaatgccaattactgttcttatcatctccctgcctggttgccacaacagcagagtatattcagggcttagcactgagatctgatttgcctctgtaaggtcccctgttaagtttcttgctgtggttctcactcccaaggcagtcatcaaatatttgttgaatgagcaaataaatcaatgaatgggtttcctgattaccttatctttaagccaccaaaaggcacctttttatgattaggcttcctttgcaagcaatgtgactctgccaggccctgggcttttgcagaaagcgaaggtggaagggagatggttattagccactgtctctgcaaacgacaagccatctgcaccccgttacctaagcatagacctctgtgggtgccaaacttcagagcccagaaagttggaagggattccgagcttggatccctcaggctaggctattcttggaagccgagcaacacgcctgccacagggaaatgagtcatgcagaggctgaaggcttgatggatttctccacggcagcagctatttatcagggtagatctatacaccacagaacacaaagggagcgatggagtacagatgagcgctacttaaagcaatatcaccctcaccttgtattgcagatccttgtattgcagccagatgacaatgcctgggaccctcttaccatccaaacacccacctcaaggaggcccagccctgtcatatgactgtccccattatacttgaacagcctttgaagggctttcaaagtgtttcccagccacatctccaccctccaagctcaggtagcccattccttcattcccgtctcaaatgttctgccccagtgaatatcttcgcctccctgttagactctgagatcttgtactgcagaatccactgttgctcatacaattctgagttgtacctgagggcagaatcagagtggtctttttgccttttgtgtttgcagagtcccaactgcagaagagagtgacatgccataaacaggtcaaatgtcgttaatataaatatctaccatggggcaatttccgaggctcttacatgcttcgtcctgaggttagcatgaggcaactgcactcactgctacgccttcccacacttattctaagggacagccagctaggatggagtgggagctgatgccctggattaaggtgcctggttaattccacttgcctggtttcctttgttctcaaactctgcctggagatgaagctattgcgaagtcagtctcagcttgtgcttctaagttctgctccttacatatgcccccagaaagttgttccaagtgaaggcagcttaattaaaaaccacattcaatcaaactgtcactttgtttatgaaaaagtgtctagtggctggaaatggcaagaacaagcactgaagattaatgctctaaattttttctgattaaaagtatgattgaggcattaagaaagctagctccatgaacccagggcaggccttaagcccaacattttgccatcttcaaatacaactggggatagttgtaaaaacaaatagaacttctctctgcctagaggtttcctttcatgaagataaagtttctagctggaactggctgtttttgcagggaagcacacatgagacaagctttttggagtctctccaatacctgcctgtttcataaatggcacagtctccaaatctgatgctcactggaccagggtcaggctatggaactgattaaaataagtaggaacctccaaggccctatgtccctactctccattttcagattggtaagctgagacctatgtactggaaaaataagctcaagggctccaagtagaaatagttgtagtcctggagtcagccttgggtttagctccacttccaaaatgtgtcaacttatagaacccttattttttcatagggttatgaagccactggtctattttatccaacagagaaatcagctccaagcaaatcccacctggacacagtgtctttgcctgactccagaaacaagatggcactctgtctccagtggttccactttacctagatttggagcctccaaaacattgtatggccacactccatctctgcctacgatggaattatgagagagctttggaaaatggctgttccaaaagtggtagtcttaacacaaagatcaggaagaatatttgatttggattaccagccacagcaggcagaattctaagatgttcccaaagtgatagtcttaatccacaggaagaatatttggtttggattaccagccacagtaggcaaaattctaagatgaccaccaatgacccatgtccttgtgtgatctcctccccttgagtacaggtgaacctgtgaatatgataggacatcgcttctgtgattatgttacatcatatggtaaaagtgacaagattttgaagatatcattaagttccctaatcagctgactttgagttaatcaaaagggagattacccaaggtgggcctggcctcatcagatgagccctttaaaagaaggcttaaaccttccctgtgctcagagactggaagcagcagagccctcctccactctccatcactggttttgaagaaggaggcctctttgagtggcctcctcatttcccatgagataataaatgggtgtcacctgctaagttggtggtcggttgttacacagcaatagatagctgatacacaagccaagaacaaataatacctacagcagtcaagatagtgatgatgtcagtgccgagatgagaaactagcaccagacattctcccacatgggcttcctttaataataataaaatagaaaaatcttcaaaacctaactggcccattttcttttcctgtcattcttttttaaaattaaaagccaacatgggtacccagggctgacttgatcacagcatgattaaatgcacttcctctagaagttagggaaaagaggactcagtgagcataggaagaggaacaagtttctctttgcaaaaacataaaaaaataaaaaattttcaaagaaaacatccaagtctcaaacctcaaacctcaaaccacttcatccaagaagaaacccccacatttgtcatttgcagaagctacagtagagacaatgcaaacaggagctagttctgggtgtgcaaatctgtgacaggtgtgcaaggcacaaccagtccttgcgtgatttcttccaaccgcagactccacgagtgcttatgtacatgagaagacgtgtgtggcccctgggagaagggagcaaccattaggacacaatatttaatgaagtgctaaactgtgcatggctgggtttaaatggtgacctttgagtaaagccagtttgatctcaggacatttccttttcaggaattacttgtatagctacctgatgcagtcaagataaagatctaaatcactgagtaaggcctatgaggcccacgtgctttcaccctgacctctctctaccctcttcccctgctactcctgtctgcatcctggactgaacttaccaaacacgctcatagagctgcttctctttacaatgttcttttctgcacctcacccccgatccctactctcctacctgacgaatttatctttcaagacatgctttataaagtcaccttctctaagaagtcttcttgaattctttctatgaagagtccttagatagccccagcatggcctgtgctcagtttcctcatcttttcaacagggacaaaaataggcattcagggctgagtgtggtggctcatgcctgtagtcccagaactttgggaggccaaggcaggtggatcactaaagctcaggagtttaagatcagcctggccaacatggtgaaaccctgtctctacaaaaaaatacaaatatgagccaggcatggggcacatgcctataatcccagctacttgggggttgaagaaggagggtcgcctggacccaggaggtcaaggcagcagtgagccgagatcatgccactgcactccagcctggacaacagagtgagaccctgtctaacaacaacaacaaaaggcattcagttgtaaaaattaaataagttgacaaatatcaaaggcttagaacctggtgacatgtcttcagcacacagtaaacactcaatgactatttatattctttactgagcacctactaagaaccaaatgttgtgccagccccttgaatacaaaacaggcatagtctctgccctttttcccactcagcactttaagcatggggctgagctcacagcctcatacagagcaaaccccttttcatgtcagtcttgcatataagtgagtcttctctccgaaaaactgctgctgggataaaagacttcctggaacctggggtccaacaccaaggccactaagaccaaaagacaaccccagtctctgaccttatttagaattcctgttcataggcggcaagaaaaagaaagatgtaacaatatgacccccaagaaggatattcccattctctagcaaaatctcattttggaattgcatgttgggtgcctgcctcttactaccatgcctcttctcagctggtgtcatctcctctggggaagtttttcatcatctttgctcaattaggaattaatctccctcatctgacttttctagtatgatttttcattcatgtcttaatcaccacctgacactttatttatttatttatttatttattttctgcctccaacctctgaaatgcaagctccgtaagggtaaaaggatatggagtgagcttaatgttccacaactgggacctaggtcagtgcctgatacatagtagacaacagtctactgacacatagatcaataaatatctattgcataaatgataatagtgttagtagcagccaacactttgatacaatttcctatgcaccaggaaccattccaagggccttatgtatattaactcatataatccctgcaacaactccctgagctaggtactgttgtcattcccatattgggaagaaagaagcttggcagggagagttttggtcacttgttcagttatatagccagtgagttacagagtaaggatttgtcaactgaagaaacacgaggttcatgcatctagaaaggagagctttatttcttataaggggttgcagcctgtaagctgaccatctcgcaggctggggagtgtagcatccagcagaaaccagaggcaggcacttcaaaggaggcaaggtgagacaggaatttatgctaacagaatggctaagtatacatactcaagttataggaggagctatgaatattcacaaaagaagggcacgcaaatgcacagtaaattaatatgaatgtcatatacatgccatgttcattttggggtgaaaacataacatttaagtatactataatttggccccatgtgtcaaaaggtgaattagaggacatgaaggcactcagtgtgcagcccccgtaaactgaccagaaccacttcatgcaaacagaagctagttctgggtgtgcaaatcttatcaggaaggaatgttgcttggttggccgtgtcaaacctgtataaagcgaggggcagagtcaggtggttggttggaaacagtgatggaacaagtcttttgagatggcctgtttctgtttaacccttaggaaagaaagccaaatgatggttagcaagggagaggatataatgtggtaagtctgagctcctgtctggttatggctaggaactcagttttcaaggtttctctgggatccccctggccaagaaggggttccatttaattagttggggtggtttaggattttatttttatttctaggattcaaaccaaccagtctggccccaaagtttatgcgcttaaccacaacactagaatgaattagttaattaacaaacaaaaaatgtcacgtctgtcacattctgtaatgcctggggccatattgggggatgtgcctgtgtgctccacgggtgtcctcttgaatgttataacctctacatgaagcaaaatcctatgtcctgcacacagtaggcactcagaaagtgtttgttgaattggatgacacctgagtttgtgcttctggacattctaaatacttttttatgcaaatctccagctttccttcccatggagactcacagcacctatgcagcaaagtgcattgttggtggtccctatccagagcttctgacaataagtacatcaaagctagggtgccacagtgacactgccatcagcttctgggccacaggaatgctcaacagatgtggataatgagtatggaggagcaatgatgccaaaaataattgttccttgggccttctagatcttctcacttcccctgaggagagattgtgcattctgcctacccaggaggacaggcaagattgcaaacacataagatgtttgtggcaacaactaacagctgtctggccagacttaactgcaagtgagcaaatcccgccttcttcactagctcagaagctgctgtaaaattacagaggagccccaggagaagctgcaccataccagggggtggagcagctccaaaaaaaaaaaaaaaaaaaaaggaaacagagaaaaaaatatctggctacatatctacctgggacaatctgttttcttaacagtacacaggaccatgtaccaggaccaggcaagcaaagcgtaggcatatgctacccctaggctaatccacagacctcggggaagagcaagccgcagtgctaggctgccaagctctaaaaatacccagctcattcccaccatgacactcatggtaagctcttagtgggcaggaatcctgccaaacaaatgcctacctagctggatgatccagaatgagcccagaggctggggactatgcaaacacaggatccagatagggacatggttttctcttgagcatgaatgaagttttaagaaaactggtgtgtgtggattaccatgaattggggaggaggaacaaggagtggaggagaagctcctgctataacaatggaagtcgatgaatgcagtggctaaagctgtaggctcgagagtctgaccaagtccatgcaaatcttgaacctctcacttaataaatacacagcactggggagaaagttaacctctctgagcctcagtttccacatctgtaagaaagggacaatgataataatcactactatatctaccgcattggtttttataaggaatgtaatagattatgttattgttcaaatatctgctgtccctcctctctacaggactcctccctactggacaattggaatcctcgccaatgttgggctgggagccagcggaatgtaagtgggagtgacagtgccacttccaggagaatctttaagatccatctcttcatctacatccttctcttttccctcttccatgagattagcaatgacctagaaaggagccctccgtcagtctgactcttgcatctaagacatgaagcagagctgcaactaacctcatataactggaacaagaaatcaactttcataaacaactccaaaatctcagtagcttattactgtagcatgaacctgcttaaactgactgatacaacagttaaattatatcatctatataagagacttaatgcatatctggcattttcttttttatttatttttgggcagggttggggaacagggtcttactctgtgacccaggctggagtgcagtagcatgatctcagctcattgcagcctccatcggggctcaagtgatcctcccacctcagctttccaagtagctgggactataggcatgcaccaccatgcccagctaatttttttttttttttttttttgagacagggtttcaccacgttgcccaggctggtctcgaactctgggctcaagcaatctgcccacctcggcctcccaaagtgctaggattacaggtgtgagccaccacgcctggccttagcaaattctaagcactcagaaaagttactttattattgctattatcagtatcatcatcatgggttctcacccttttggagacatcccataccttgttgaaagcttttgttgttgtttactcatgaaacctttggaccctctcccttgagaaacgcacatttggacacaattttgaagataagtgcaggtagtttgcacatcccaggctcagagcctctgttagagtctcccagattgaaaaattcatcctaaagtcgatttcctaagcttcggcctggaaatactgccaacatagactctgtgtcatgtcaactgtcactgagcacaaacaggtaaaaatgccacagtgccactttccatcctggacaaacagcccaggacatacagggaggcagggattggcacacatggaaggagagtgctggcccctggctgcgtcctcacctctgtgctcagggctgtgagtgaggatggcagacacaacaatctatacccaccctagacctgcggcatctcttaatctgtgctccacaagatcagcgtctgatcctggggccgcgggctgtctggggaacatgcagttctttagtgtctggatatcattagctaatttgtgtgtccaatttcaaagaaatgtttcctccctagaggagtttctactcaaaggactggctatttttggctcccacccactcggctgtgttgtgcgaagccagcatttcctagactatcccaacccccaccttttcctctctccagagtcagcagcactggagtccaaaacagtctcctgggcatccccatagccttgtattcccatccatctcgcaagaaaagataagtcagcactcttgtagaggacatgcttccaactaggatcaagggaagagcttcattcaccctttctttctcttattcatccattcatttgtttaacaaataattattgacacccttctctatgccccattacatattgtctgtatgacgttgagcaagttacataatgtctctcctcatgcctcagtttttttatctaaaaaatgggatgacaataagaacaacccaagaggccactgtagttattaagtatattaatatatccatagcatttaaataatgcctggcacaaagtaagtgctcggtaaaatgttagttgtactttgtcaactactgtagtaatcaatagggacaaaacggtgagtgaaaactaatacagttcctgcccctacgaagctgatgatccccgaggagaaatatacattaatcacataccctggaggttaaagatatattcagtactccttgattttggtgatggtatcacagatgtatgcatatgtctagattcattgaaacgtttacagtaaatatgtgcaattttttgtatgtcaactatacctcaaagctttataaaataagcacaacaatgaatgttaaatatgtaaccaccataagtgttaccaacgagaagcatatggtgggttccaggagggcagttgatacaggttatggtttaggaacgatttttctaaggagtaatgatgaggttgaggtctggagaatgtctaagaattatgagagagtttggggtatgtgtgcttctttccgggagggttgaggggctctgtttcagacagaagaggcaacatgtaggaaggtcctctcaatatctaacactgttagacatataaaacccttgataataataatcaaataatcagataataataacagaggtctaaacgggaaactataagatttcaacagcaagctgtcttgataaggttccatcatctctcaaaaatttataactaacaacaagacaattacttcccaaatccccttgaaattaattccatcctcctccaggagctatgatgggtgggaaataaaaccgatgagggggaggctcaagtagtagtgatcatatcagagcatatcaaaaccttggtgaatttttactctttagtttgacatggaaattttccctaatcccaagacatagatgataccatgtgataaaaaaaaatcttaagatacatttatccatttattttacagcttttttagtatttaggacctaccaggcattatatgaggtgctaaagacacaacggtgaccaagacacagtctactggtctctgtcccctatactctattttaccatatctatctccaaccctgtcagacccaagagggaggggtttccagtagccaaaaaaaaaatagacccaggcaaaataattttgaaatagaaaaacaatggtgaaggacttacattaccctcatttcaaacatattacaaagctacagaaatcaagagagtgtggtattaagggaaagagacaaatcactggaacaaaactgaacgtttagaaataagctctgacactgtcaattgatttttgacaaacatgacaggataatttgataggaaaaagatagtcttttcaacacatgatgctgggaaaatttgatatcaatatgtgaaaaagtgaacttaaatccttatctccaaaccacacaaaaattaactcaaaatagatcttagacctaaatataacaactaaaactataaggctccttgaaaaaaaaattagagaaaaccatcatgtccttgggttaagcggaaagctcttagacacaaaaccattcattattcttttactagacataaatgaaaaaataggcaaattcatctccattaaaatttaaaacttttgcactccaaagacaccattaagaataaaaagacaagccagactaggagaaaacatttgcaaatcatacatatgataaagaactgtatcaaaaatatataaagaactcctacaactcaataataaaacaaacagctcaaaaataagatgagctaaaaaactctatactcaatagttatttcatcaaagatgaaatacacatggccaataagaaatgaaaaggagttaaacatcattagtcattatggaaatgaacattaaaaccacaatgagattccacttccatatacacactagaatgactataatggaaaatatggacaacaccaagtgttggcaaggattcacagaaactgaaacccttgtacattgctgatggcaatgtgatatggtgcaactacctgtgaaaacagtttggcaattttttaaaaacttaaaacgtaaagttactatatggcccagcaattccacttataggtatcaacccaagagaaattaagatatacatccacacagactggcatatagatattcacaggagtattatccctaacagacaagaagtagaaataacccaaatacccatgagctggtaaataaacaaaatgttggctgggcgcagtggatcacatctataactttggaggctgaggtaggtgatcacttgagccaggagtttgagatcaacctgggcaacatggaaaccccatctctaccaaatacgtatgtatgtgtgtgtatacacacacacacacacacacacacacacacacacaaacacacaaaattagctgggtgtggtagtgtatacctgtagtcccagctactcgtgaggctgaggtgggaggattgcttgagcctcggaggcagaggctgcagtgagccacagcctggggaataggccccatctcaaaaaaataaaaaataaacaaaatgttatatatccagataatggaatgttatttggaaatagaaatgtagaaaacactgatacatgtgacaacatgaattaacctcaaagacattatgctaagtgaaagaagccagactcaagagactatatattgtatgattccatttacattaaatttccagaaaaggaaaatctatagagacagaaagtggatcagtgcttgcttggggctggggttaggagcaatgattgacaggcctgagataatttttttagggctggtgaaaatgttctaaaatttatttggggtgatggttgcaaaatctgtaactttactttaaaaatcattggattatgtatttacaatgagtgcattttatgataagtaaattatatatcaataaaggtattaaaataattaatcctctaacagcccacacaatagtttagtcatctgcatgccttgatatacctccagtctagtcctttcaacaaagaatagaagagtttagtcaaatgaggagtctttgggattggaatggttctagcctcattctctaaataattctacccaaacaatatttaggaataatttttttagagtggcataaacaccataattacatgcacatacttttcatcttttctgttctagaaaaggagtcttcttacagtccaaggaaaatcagtctctacactgaattataaattaacatttcagcagacatgcaatgttgtgtgaggtcttcccacgttagcagtcggaatacaggggacagcatcacctcctttgcctccagaggtctgagggtgcagtggaaagagatcagggtgtcttcaagagtttgaatttctctcttctcaagaatagaaggaaaattaagcattatttttttctctcaatgattttgccttttataataagtaactcttatagactccttactatgtgacatgccctgtttcaaacatataaaatatattaactaatttaatgctcataacaactctatgaggtcagttctattttatcccttttaacaaataagtaaactagagcacagatgggttaagtgacttgtccaagatcacacagcaagctagtagagacgggattcaaactaaacggtaactcaagtcccttctcttaagccctccatctcatgtactcagaggcattaaatctcaaggtatacataaaagataaggtaaaaggcagcatgaaaagttgctttttttttttttttttaacaggctggagtgcaatgccacaatcttggctcactgcagcctctgcctcctgggttcaagcaattctcctgcctcagcctcccaagtagctgggattacaggcacccaccaccatgcctggctaattttttgtatttttagtagaggtggggtttcgccatgttggccaggctggcctcaaactcctggctcaagtgatccacccgcctcagcctcccaaagtgctctgattacaggcatgagccccacgcccggccaacctttctgaaacccagaagaaagaagagcaagtggggctcagagtcacagttgctcagcactgcaggcagggtccgtatgtcataataacagatggggtaggtaccattgctcttgcagcctgcaggtcccaaaggaaattgtgtcattttatcttgcctagctccaaaaggagcagcctctgtcagaagatctcaatcatcataggcacatcccaggtgtgtgtcctgcttctcatcaggcctccccatcttactagaccactaggttcagccctgacttgtaggaggggctgggcctccatagcttctaaaaacatacagttaatctacagcatctctcctacatttgctgcgtagcattggcaccttcactcaagtgacagtattatagtcaggtggcatcgatcagctttaatcagccttatatttaagagctagagtctctgggtgttttagggaatacccgggcaacaaagtgaaaaaaaaaaacaaaaaaccttttgcagtagattgcatgattgcacaactggcccaattcttcatctcttactggaaacatgtcactgtcacgtgattctgtggtccctgccacttaagaaccaggatacagttcctcacctcttgactttgagtttgatcacgtgacttagtttggccaattacgtgagggagacgtgccagtgtgccggttttggcttttgcccagggtgtctaagaccgtagggaagagattgtctgggaaactctgcccaagacatcaccagagagcccacgtagtgtggtttctctccttgtatcaatgagaatgaaacccaaagagaactgatgcatcacccagtgagtgaatataggagctacagtgaaacccatgtctcctgtcctcctactccaggtttctaaacaggaagcatcagaacctggctgtcagaaaaataatctgaggccccaaggtttcatggagcagttactctctgctcagcactaagccacgtgtacagaggagataccaataaggaaaatgactgggtccctggttataatgtcctaaatctgtaatggagtgaatcaacaagacacttgcaaacaaaatggtgagggctcaggaggctgtaatttttaaaaagtgctggactgaggaaaggtgagagttacaggctcagttctgccactcgcctgctgtgtgactttgagctggtcattccctatctcttaataacagcttcttcatctatagaatgtgggtatacatgaggggatttttttagaactctagttctcagttctgactgcatattattctcaccaagaaaacagttttttttttttgagatggaatctcgctcttattgcccaggctggggtgcaatggcacaatctcagctcactgcaacctccacctcttgggttcaagcgattctcctgcctcagcctcctgagtagctgggagtacaggcacccaccacaatgcctggctgatttttgtatttttagtagagacagggtttcaccacgttggccaggctggtctcaaactccttacctccagtgatctgcccgcctcaacctcccaaagtgctgggattataggcatgagccactgtgcctggcccagaaagcattttttaaaagaggaacccagacccttggagaaatgactgattgctgattccagggttgaagcaggaaaagtataaaatgaaccaagagcatcttattgttccagaaagtaagggaatgtgcaccaaaaaaaaaaaaaaaaaaaaaatgaggacttctagggatggaattttgtcccctacaaattcatatattgaagccttaacctgccattgactatatttggagatagggcttttaggaggtaactaaggttaaatgaggtcataagagtaggaccccaggttgataggactggtgaacttgtaagtagaggaagaagagagatttctctctctctctctctccaccagcatgcactgagaaaaggccatatgagcacacagagagaagacagctgtctgcaaaccagtaagagagcccttactcaaacccaaccacgccagctccctgatcttggacttccagcttttagaaccatgaaaaaaataaatttttgttgtttaagacacccagtctatgatattttgtcatggaagcctgagctcactaagacaagaatgtgtcaaaagaatacaagagccaggttgaggtgctgaccgataaaatctgagacaatttaagcataaatataaataacgacagtaatggattataacccactgtaaaattaagaatcttgagcccatgctaatataaagtataaaagtaaaaataaatgttcttccttatagcagaacactagtaaagagaaggaatgatggagttagaaaacatcaatggatgctaaagctggtgagtaaaaacatgataaggaataggatatttatatagtctcaatgtatctgcctaataatataggagctacattgaaagtgtatcccgtcttcctagtgcaggtttctaagcaggaagcatcagaacccagcatcagaactccctacaagttacttgttaattacaaagaggaaatagcaactttacagtagagactgcagatactaccttaaccacggagtcaaaattaatatcaccaatatcaagaccaacggacatcatctcttgatacaatgcaccaagaaggacacaatatcacttcagtgatattcctacaaaaaaaaagtgtgaaagaaatagggcaaaatgtaagcaactggtgaatctgaataaagagaatataggagttctttctactattctttcaacttttctgtaagcttgaaaatatatctactcatgacacaagtttacctgtgtaacaaacctgcacatgtacccctgaaataaaaagttaaaaaaagaaaatatatctaaatgcatatacagtttaaaaaacatatgagcccaagccccaccccagactaataaaatcagattcactgggggtttagggcccaggcatccatgtttttgtttctatgtttgttttttaggctccttgggtgattctaatgtgcctcctaggttgacagcccctacgggactcagaggatagtgacattctgacattctctggacctgtgggtaccaaagtaaatggtttacagcagttcccaaccagcagcagcacctaaccacccggagacttgtaacaaatgcagattcttgggcctcacccagacctactgaatctgacacttcggtggtgtaccggcaacctgtgctttaatcaggcatctcggggtttctgatgttcactaaagtgtgagaaccatggtctatattgattctcaggtaactaatagtgttcttctttttcaattttttttaaattgtggtaaaacacacacacacacacacacacacacacacacactttactctcttggccggtcagcatagacttccagccccacatcacctttcccaaatgtcttccaaggggcaaagtccagacacaacagtgaaagtgtggattttactccactgttctaactatcagttctttcttgctggtggtctcatttccctgccctcctccttacctgtgccacataccccattctccttgtacttcccctactggtcagtcccccacacatagacctgctacaaccacaactaactccttgagactaacctgtcctctccatcactctcaagccacattctctgagcctgcccaggagactaagaaccaatgtggaattaacaatttactgaaaaagaccagatccctttcccaggtgtgaggctatagcacgggtgttagctgtgataatttttaggtggtacaaggagactgaattaaataacatcaagtcacatggtgcaaaagttgctccctttcaagtctgtttcaactcttctgaaaacatcagggaaaaagtcccaaacaccctacaacactcgctaatctccctttttaacagcgagatcaggcctcaggctctgagccttaggcagcagtctctgagctgtttggtcttcgtggtatatatttttgcaacttactttctatttgtgggaagtgatactggttttccatttctggctgtgatgccaagttgctttttaaaaataaatgtgcttaaattaaaatgcaagtggtttaaagcacacactaaacaaataatcgtagagatgtttgaagttggaaaacagagaatgaggacccgggcttcttccctgtgaaatcttcaccctacatatatcattttggtgtcttggagactgcatcctaccatgatctcatctatgaagcaacaggaaaggaatggagtctccagtgagattggatcagcagtttcattagaggggctggcagagaacacttttgctcttcctcctggtccctaagccttcctgaaacccagggactggaaagggatcctaaccaaatctgcagctattggcatatcctagatcctagtgagccagaggtgggcagtggtggggacagggatggctgataaatgtgggcagatccctaaactgcatccgaccctcctgcactttctttcttaagacccttcatctaacatgtaggagaactaaagtggatcctcatctctcaccttaagcaaaaatcaactcaaggtggatcaaggacttaaatctaagacctaaaaccataaaaattctagaaggtaacacgggaaaatcccttctagacattggattaggcaaagatttcatgaccaagaacccaaagcaaatgcaacaaaaacaaagacaaataggcggtacttaattaaactaaagagcttctgcacagccaaaagaacagtcagcagactaaatacacaacccacagagtgtgagaaaatcttcacaaccatacatccaaaggactaatatctagaatctacaaggaactcaaacaaattagcaagaaaaaaaaacaattagcaaacaaattagcaagcccaaacaaaagtgggctaagggcatgaacagatagttctcaaaagaagacgtacaaatggccaacaaacatatgaacaaatgctcaacatcagtaatgatcagggaaatgcaaatcaaaccacaatgcaataccactttattcctgcaagaatggccataatcaaaaaattaaaaaaatagacattggcatggatgtggtgaaaaggaaacacttccgcactgctggtgggaatgtaaactagtacaaccactatggaaaacagtgtggagatagcttaaataactaaaaggagaactaccatttggcacagcaatcccactactgggtatctacccagaggaaaagaagtcattataccaaaaagacatttgcacacacatgtttacagcagcacaattcacaaatgcaaaaatatggaatcagcccaaatgcccattaatcgacaagtggctaaacaaattgtggtatgtatatatacacgatggaataaaactcagccttaaaaaggaatgaattaatggcatctgcaccaacctgaatggaactgaagactattattctaagtaaagtaactcaggaatggagaaccaaacattgtatgttctcacttgtaagtgagagctaagctatgagaatgcaaaggcataagaatgacacaatggacgctggaaattcaggggaaagggtggtgaggaataaaagactacaaattggattaaatgtatactgctcgggtgatgggtgcaccaaaatctcagaaatcatcactgaactactcatgtaaccaaatacctactgtcccccctcccccccccaaaaaaaacctatggaaattttagaaaaggaaaaataaataaataaaactagtattgatttgggttatttcagtttgtgttctccaaatagttgttaaaaataatttagaaaatgctcaaaaaaaccactcatctagaggaatttagatcacagcaaagaaatttctaacattccccataccttgtgcatctgacctatgatttttttccttgaccttaaaggcttacaaagggcatcattatgagtaactgcaaaaccattatgaaaatcaactccctattttggatgactccccatgttcagcataaaagatacttactcaaaagcttggtgttttcattccagaagaaactccttttaatgctgcaagcagcattacaattttacaagagaaaaataaaacattcttagtaattaaatgcaaatcaccagagctcagaattcagggccctgtctctggagtgcctagattcagcactgggagaagcaaataactgagagaaggaaagagaatgccatcctgtctccctcccttgcacccccttcctcagctaactagtgttcccctggctcaaagaaaatgtggaagttggtggtttttcacaaggatgatactatctggagctgctgtcctctgagagtaggacgggtcagaagagatctgcacctgctctgttaaggtagtcttgccatctctaagggtttgatttgctggcttgtttactggagtcagaaacagaataaaggtaactcacttcaaaggctagattcaaatgctacttcctagaagataccttcaggaccctccttcactcccaaatagaaggaactctgctttttcaacatggtattgaagtcagaatgtttgttattccaaacaccagtactgaaacgtctgctcattccgtgaagttcctgaggtgccgagtgctggggatataacagtgaagatggataattctccattcttacggagcttcattgagggagctcagggaggcaggagttagtcaataatcacaaaagtaaagcaacatcacaaattgtagcgagtgctatttaagtacatgaaaacaatttactagtcaagaagtatcagcagaatgaacagcaggtgcaaagggcccatgtcagacaggtgaaggggggacatgagggcaactgcaagaaggccaatattacttttgcaaggagcaggtgagacgtggggctccagaggtagccgaggtcagccatgaagtgcttggaaggccacagagacaaattttattcctatcaccatagcaacgggaagccatgaaaccgttttcagcagagaaacaacatgatcgggtttgcattttgaaagatcccactggcttcagtagagaggatagattttgagcaagaagcaaagatgcttgtgcaaaggagagtaattcgaagacctttggtagtcctggcaagagatgttgagtgttggatcacagagctgctgatggaaatggggagatgtatttcgactgatgttggtcaagttacttctttctgcacctccatttcctcatctgtaaactgggagtaataagcccactcacctcccagtgaaatgagatggcatgtagaaagcacctggcacatcctgatgattcaataaacgatagtcgttgttatagtgatgatctttgtaactcttgtaagatgcttttcagttcacatctttttaaatgattgtctgtccacactgttcactccatctgtgcagctttatgttatttgaaggcatagtgcccccctgctggattcactttataacaatcagttctcccaccaggatgattagcgcccagaaagtgtaagtaaatatttgtggagaaaactgatttgaatggcccagatggtggcactcagccaggctccctaaccactggagttaatccatcacagacgtgctggccaatgtttttcaaggtgtgattctccaggtgtgacttccatggaggagacacttggatccgatctgccttcaaaaaagaatgtgtcattcagccactgggggtgcaggttactgacatcctctggcttcagagccctcaggattcacttccgcttttgagctgaggtcacattctgccagagcagtcctcagccagtgacagggcatgagggggacatggggcccggcaacttctgcccaacatggggctcctttcatgggcaacctcttctccaaagctttctgttaggttggcagagactgtctggtctgcatggtggtctgaagctctcccttgcacaattctacttcctgccttccctattttattttttcccaggtacttatgccctctcaataaacttcttgtgcccctaactccatctcagcatctgtttcctggaagatccaactggctcaccttggagagaacagaaactaaaagccacaacatgaagcgtatacaagaaccaggtaagttaagtaactcagagctatctcttgtcccaaaggatgaaaacctccgagcgccgtggaagagaacagtctgattaagttggctcaaactgccaggaagctttctgagcaacagcagatgttggggcttcgagaaagattgctctctgcttttggccagaatccctggggtcatttaggtggtgatgttgccagttcttctcccctctggccaacacctctcaatccattatttgggataccaattataaacttgggacaagagcctaatctcccagcaaggaaaacctgggctgtcagtctactttaccaatccctgccttggaaattgctatatatctcaggctacaagaaagtagagggagacaagagaaaaagcatccctcacacaaccttcagatcttccgctggagagatagccccactctaggagggaatggttattgctataatttgggggatattttggcaggtttgggaaaatctattcaaagtttagtttagtctcaatttctagaacatcgagccacttttgtgtaggcaagggtgacaggaaaagctgaaaacatggtggtaatcctagagataatagtaatagcagtatttatggagcaatgagtatgtttgtagattgagaggggtattttttacagaatcagctcatctaatcatcacacgaactcctagacattggtgctattttcaccaactatttcaataaggacacagaggttctgatatggtttgggtgtttgttccctccaaactcatgttgaaatgtcacctccagtgttggaggtagggcctggcgggaggccattagatcatgggggcagatccctcatgaacagcctagcaccataaccctggtaatgagtgagctctcgctcttagttcacatgagatttggttgtttaaaagagtgtggcactgatcccctttctctcttgctctgtctttcaccatgcgatatgctacccccctttcaccttccaccatgattggaagcctcctgaggcctcaccagaagccaagctgaagccagcaccatgcttcctgtatagcctgcagaaccgtgagccaattaaacctctcttctttacaaattacctaatgttgggtatttctttcttctttttttcttttttttcttttcttttttattgggggggacagagtctcactctattgcccaggctgtagtgcagtgttgtgatctctgctcactgcaaccttcgcctcctaggttcaagcaattcttgtgcctcagcctcccaagtagctgggattacaggcatgcaccaccatgccaggctgccttgggtgtttctttatagcaacacaagaatggactaacatgggctcagagaggttaggtaacttgtctaagaccacagagctagcaagaggtagagctaggattcaaacttaggtctctccaaaatcaaagactacatttatcctcccttcctccactgttctagatcactcttgcactggggcactcttgctctgagagacgtatcccactcacagacatggagtggatgcctcggttgctgcatcatttaacaagcatctattgtctgctctgtgccatcccctatggtaggcactgggacgaaaagaatgaatgatccttgacatcaagaagctcaaagactagctggaaagatactaatatagcaattccttttattttctctaataggagacccactcgcaactatgaggaatagatactatcagcagcaacagcaactttttttttaaggacaaagaaagtaaatatgggaaaatgtaaacttgtccaaagacatacatctagtcatgagaaagctgaaacccaaaacagctaagctgatgtatcacagcctctgaatcaccatcactgaaagaaacaacacacttggggatgggggagtggctctccttgcacaagctgggatgcaatttgcagacattttgcagagcagaaaatatatgagtctctgaagggcagtgatcaatcatttcagccatcttaaatgagaccagaatagatacaagaagaatctcagccacatataactctaaccatcaagggtattactaacccccaaaatatttcatcttcttgaagttttatggctatggctcttgagtgttttgggggtacagggagatatgggtttaggcagctgaagcaatacctatctatagataagaatatcgccagaagtcctaataacctcagaaaatctacaaaacaagagagtccatatgtatgccggaatccctgcccctgacatgtttactctgctgactacctccagtgacagaactctagacttaattagccagctcatagctcttccacatactttttggaggtagattttgtctctatgggctctacttcttcccttagattctagagcaccatggaatgtatctgctctatgttcaagatgaaagcccttcaaataattgggtatagcaatctactcacccctctcacttcctcatttctctccactctcagaaatgcaaacatttatccttttgttgatgttattcaggaaccacttccagcagcctgtacctcccttagtcatgttccttttaacaagctcagtttatcaatgtccttcttaaaatacagaactcacacatgagcataaccgaagatacaatatttgtgaagggactgtgaaaacaagagtaggcagaggcaaagggttgttattttttctctaggactaaataaaaatataaatgctatttctcttaacacaaaccagtttgaagaaactattcgacgtattcattctgtcatctgttcattcatctgttattgaacctttcaaggtaaaagattagaggattctggccaggagagaaaagagaaaagtggatggatatgaacactatgtagaaggtgtagtcacagggcgaggggtgtgagggaaatggtggcagcaagaagttgagcctgggcatctgggaggatggtggtgccatgccctggaggaggaccagtttgaagaaagaatatcataggagtccaataaatactactagaatgaatgacttaataatcagtatgtaagttacattcattcccctctgcttctggctttccatctgattagatcaaaagcactcttgcatatggaaagcttgcacgagcacaattttacgtggttatgggaaggaatggtgttctctatgtgtatttttattttttccaatgattggattctccagggtgcgcacatgacagagacaagtttctgtactgagtcctgattccctaggcaaaaagtgcaaagcataccgaaaaataaatatccagccttaaaaaatcagtacaacaatcccttggctcccatgaacatcgtagaccccactgtgtgcaggggccgcagtcgacggcagggtatgaggagaaacaggacaggtttccatgtcccttgtgagcgcagagtgtaggaggaagattgacaggaaaaccaaaataagacacctgaaactccacgatatgataaatgatatgacaacagggggaggtgctaaatgttacgagagtgcagcagaggcataaaataaaagaagcctgaagcaaacttttaattcgttacacaaaaaagtctttagtcttctttgccgagattaaagcagtgccactctgggtctggagccgaactggtagctggggtctagaagaattcagagttcatcccgagtcttctctagagatggaagcctggagaagcctggagaagcctggggaagccagaaggccctgaacccctgacaaaaagcctaaggatcctcacccagcaatgctgaccacgaccattaaaacatgaagcccacccccaaagaggaaaatccttgccctttaatgaagctgccaaaaacctccaaatttaacagtttgcactgtgtctttctgcagacacagaaaaatgagctgggaaatagaacagtcacatctggccaagagagttgtggacttttgaggtgttgcctgggtctcctgggcagtagaatcagctgacccaatgtttaatagagaaactacaaattttcaaacataagaaaaccatgtaaaaaaaaaaaatcaatgggggagggggtgtttaaatgcatttgagaccagccatatgacagcgatttggaagcccttataacccttagttttaataacataagaattccctatgaaattctaaataaggctgggcatggtggttcatgcttgtaattccagcgcttaaggaggctgagttgaggtgggcagatctcctgaggttaggagtttgagatcagcctggccaacacggtgaaaccccatctctgctaaaaatacaaaaattagctgggcatggtggtgcgcacacgtaatcccagctacttgggaggctgaggcaggagaatggcttgaacccaggaggtgggggttgcagacagctaagatcgtgccactgcacgccagcctcggtgacaaggcaagactctatctccaaaaataataattctaaataaagcaaaataaaatgtatgcataaacatatatatgcaaaggtatatgtatatgcacatacatgcatacatgtgtatagatatatgtacagtatagcctgccagctatgttaaaagaagttttttgcaaagccaccttttgtgtatggaactgtgtgtgaaaaaagacttatagaactgtgagaaacttggataagatgaggcatgcgtacttccccatctgaaatagccaagatgatgaccattcttataagtgaaagagttttttttttttgtttggggaagtgtttttttttttctttttatctttcattcctgttcaaattcttttttaatttacacataagaaaaagtggtctggcacagtggctcacttctgtaatcctagcactttgggagactgagagggaggactgcttgagaccaggaattcgagaccaacctgggcaatatattgagaccctgtctctatttaaaattgttttaatttaaaaaaatttacaataaataaataaaaataagaaaaacctcccaaatcccaccactctagtacaaccaaagtggccacaccatcacacgtgaggttgttcacagcatccttctctggggatgattctaagtcccttgaagatagggagcgtgactagtttgtctctgaatccctggtacctggaagtggcctgacccccagaaggcactccgatgacgtctgttgaatggatagatgagaatgcacataagaaaaagtgatttttttcctaacaaagtaaaatggcattccacggactttggggaagttggctccttcacttctagagaaaaaaggagaataaggcaggaattcaaaatactcttatgaacagaaaggcaacaggtagagcaggacatggagggattcatgaagggagagaaggaaggcagggaagctgggctgtgcaataagcagcaagcctgggtgttatttcagcctcccgagaacatgccagaatagacattgccattacctccattttcagaggaagaaactaagacaaatgaatcagacagaagacatgatgttcatctcataaatggacatgtggagatttgaacccagctcagctggctttgaattcagaaatctttacccctaagggacatcatgaagcaagacaaagaatgaaatggagggctaggatgatgactggatttcctgctgattgaaggaatgttgaaccaagcacatgtacttcaatcctaaccatacacagggaagttctttctgtatttggaagagctaagcggaagatctcagcactagtcccagcccctgtgtccatgccatttcagcactagataacaagatatatccatgtaggaagatggatgaggaaagcagggtggatctgtctcccccaaaggaaaccacaaggcataaacagcagcagtccccagaggacaatgtacacacaacctctttcctccaactctggtgttgaaactgccctgagctgactttaaatccactgcaggtagttgcatgaggagtacttacaggatcctgctggctctgttgctactctctatcatggagtcctgcagcctttgaataaatacctgccaggccaagctagcaaatagcacagtttcatgtctggaatttgcagaccagggctgaaggaagttagacacgcttctgtgaagaaaactgatattctgctggggtttgcaagatccctaaaggtcccgtcctccccctgggaatcccagcagtttagaagattcctgaaagggaaaggagcagctcacctgagacaagcaagggccagattgttgaagccatcgttgccctgctgagcttcaggacactcaactcacagttgcagatttcataagcaacaaaaagaagaatccatttcacaggcatttttcagtgcctgtctgaccacactgatcaaggcagtgggggtacagaggtgcacaaaacgtgcaaagtgcctgctacagtgatgcttaccctctggtggggagagctgaagttctgggaaagtacagtttgagggaatgcctcatatgcaaaaggccaaccctgggctagatcctactcatgtatgtctcatccagttcctcccaataatcccaagattaggtactccttgcatcaaatcattttaaagaagagaaaattgagtgtattagtccattttcatgctgctgataaagacataactgaaactgggaagaaaaagaggtttaatggacttacagtaccacatggctgggaaggcctcacaatcatggtggaaagcaagaaggtgcaagtcaagtcttacatggatggcagcaggcaaagacagagagcttgtgcaggagaattcctctttttgaaaccattggatctcatgagaccttattcactattgtgagaacagcataagaaagatccacccccatgattcagttacctcccactgggtccctcccacaacatgtgggaattgtgggagttaaaattcaagatgagatttgagtggggacacagccaaaccatatcattgggtctcagagaagtaattgcctcaagaatcacacagctgacaggtaacagagccagaactcaaaccccaggcctcctgatcacagctgccatgttgcacaaccctcatctcagaaggaatcagaatttgtgttcacggttacacgtgttcagggtcacacacttagtgtacgatgtagccggggttaaagctgagatgagccaactctagaccctagtctcttaaccactatagatactgctgtgctagcatacttggaaaccaccatatatgttcttggaaattcaccaagcacattaccatgttaggcagacttattactattctgcagtatctgcaagtaacatagaagcaaaaaaagcacataacacataaaataattacacatagacctgaggtagaaaacaaataatcagaggagaaggcaagagaaaggtgaagccaccttaggtagaatggtcaggaaacatcctttctgagaagacatttaggctgagaagctaattaagaaataacagagaaaactaatgaaacccaaagctgattctctttaaaaaaaaaaaaaaaaaaaaacaaaattgataaacctaggtagactgatcaagaagaaaagagactatcagaaataaagtctggtgcattactacagactttaagatattaaaaggattaaaaaacccttatgcctataaatttgacaacctagatgaaatggacaaattcctggaaagatacaaattaccaaagctttttcaaaaagaaatagaaaccttcaccaaccctgtatcaattaaagaaattgaacccatagtttaaaaccctcccacaaagtaaacttcaggcccagatgtcttctctgctgcactctataaaacatttaaggaaaaaaaaaaaagagtcctacacaaattatttcagaaactagtgttcagaaggcaatacttcccaattcatgttatgaggatagtattaccctgattccaaaaccagaggaagccattataaggaaactctagaccaaccttcctcgcaaacatacatgcaaaagtgccccacaaaatatgagcagatcaaatagaaaaatgtaacaaaaggcaatgcattataaccaagtacgttcacaccatgaaggtaggctgaaatccaaagaacaagaaataaccagattacaaaaaaaaaaaaaataggaagaatgaataagacctaccatttaataaatggcacaacagtgtgactatagtcaataattgaacatttttaaataacaaaaaatatataattggatcgtttgtaacacaaaggataaatgctcaaggggatggagacctcattttccatgatgtgattatttcacattgcatgcctgtattaaaacatctcatgtaccccataaatatatacacctactatgtacccacaaaaaaaataaaattttttttaattttattattattatactttaagttttagggtacatgtgcacaatgtgcaggttagttacatatgtatacatgtgccatgctggtgtgctgcatccattaactcgtcatctagcattagctatatctcctaatgctatccctcccccatccccccaccccacaacagtccccagagtgtgatgttccccttcctgtgtccatgtgttctcattgttattaaataaaaagaattttaaataaaaacagaaataacctgtcaagtgaagaacaacaagaaagttctgggcaaagggagtggcacacgcagaggctacagggtaagaaagagcttggcaaatttgaaaagttgaatggaaaccatttggaatagcatttaacgagttaggggaacgtggtaatggatgagactggagaatagacaaggctagatcacacaggacctcatcaaggtaaatagtttggattttttaataaattctaatggacgctattacatggtttttacctggggaatgtcgtggaactgtttgttttaataaagatttcttaacagaatatggagaagcaagtggcaagggggcaaagtggaagagagataccaatgaggaagctattggagtgatccaggggagtgatggcgccagccaggactggggggtgcatgggcaagggagaaaagtgggtaagtcaagggatatttcaaagataaaaccaacaggatttgctgacagactgcaagtatgagataaggagaaatcttgtagcaggttctggataagtgatcataaatcctactccgttttcctcctgggaatatttagtccataaaaaacttcccaggctccactcctttcacagctcaacacagatgatgtcagtggccttagaagccatatgttgaaggtggcagaaccaaaagatgaaaggagctgagcccctgaatcgtcacttgtcagagggccgccctctgaatacaaacatccacatttgacttcagacgagtaagaagtacatctgtggtggattcagtttctgctattcagggatgtatgtgttaaactaacttttcttaacctaattacttcagacaaaaatcaagaaaaagctagtatatcagctcgaccaattaagtggagctaagaatactcttacttcagctcttaaaagaactgattgaaatgagacagtttggaggctttcaagggatttgttcaattccatttctaaaaggaatctatactgagaaaataacagtaaatataaaggtttatgcacagagatgtttatcagtggcatttatattagcaaaagtttccatgaaaatgaccaaggcacccaacactaagtggttaaataaccaccactatgggcattaaaaattatgcttacagttcccaggcccacagcgtcagcagcagcggcagcagcggcaggcggccgcgcgggtgtttgtcgcttcgcggggccttgcggcagcatggcgaaccatctgatcagtggcggcaccggctacgtgccccaggactggctcaccgtgcagcagctcttcctcggcgccaactgccgcacccacaacaacttcctgattctcccatggttcatagatttcatagctgatgaggtagacctaacttcagccctgacccggaagatcatgctgaagacaccactgatctcttcccctatggacactgagacagaggccgacatggccatcgcgatggctctgatgggaggtattggtttcattcaccacaactgcaccccagagttccaggccaacgaggtgcataaggtcaagaagtttgaacagggcttcatcacggaccccgtggtgctgagcccctcacacactgtgggtgatgtgctggaggccaagatccggcatggcttctcttgcatcctcatcactgagatgggcaccatggggagcaagttggtgggcatcatctcctcccgagacatcaactttcttgctgagaaggaccacaccaccctcctcagtgaggtgatgacgccaaggatcaagctgatggtggctccagcaggcatgacattgaaacaggcaaatgagatccttcagcctagcaagggaagctgcctgtggtcaatgatcgccatgagctagtggccatcgtctcccacaccaacctgaagaagaatcgagactacattctggcctccaaggattcccacaagcagctgctgtgcagggcagctgtgggcacccatgaggatgacaaatactgcctggacctgctcacctgggtaggcatcaacgtcatagtcttggactcctcccaagggaactcggtgtatcaaatcaccatggtgcattacatcaaacagaagtacctccacctccaggtgattgggaggaatgtggtgacagcagcccaggctaagaacctgattgacactggtgtggatggactgcatgtagttatgggctgcagctctatctgcatcacccaggaagtgatggcctgcggtcagccccagggcactgctgtgtacaaggtggccaagtacgctcagcactttggtgtgtccatcatagccgatgtggcatccagaccgtggggcacgtggtcaaggccctggcccttggagcctccacagtgatgatgggctccctgctggccaccaccacggaggcccagcggcgagtacttcttctcagacagggtgcagctcaagaagtactggggcatgggctcgctagatgccatggagaagagcagcagcagccagaaacgatacttcagcgagggggaaaaggtgaatattgtgcagggtgtctcggcctccatccaggacaaagggtccattcagaagtttgtgccctacctcatagcgagtaaccagcatggctccatgatgtactcaggagagctcaaatttgagaagtggaccatgtcagcccagatcgagggtggcgtccatggcctgcacgcttaccagaagcagctgtactgaggatagcagtggaggatgaggtggtggagggagcataccccagtgtccaccttcgggcacaacctctctccataactgagtggtccacagatttgcactacgggttccccagctcctttccagggagagaggaggagaggtcctgaaggctctgcagcccctcgctgagcatcccctacagagtcgggcctgctccctgggccaggctgcctgggggcgccccccagcccagccagccaggctctcaggccctgcgcctgcctcaggtctttcttgctgcagcatgctccagcatggcccccaccccagggacaggaggccccacctggcttctcctgtagggtacctccctgcccccagcccccccaggaaatggtgctttcctggctctgcctctggctcttcccgggccgctgccccctcagccatgtggcacttctgagctcctgacctaggccaagaggaggtctctgcccccttccccggtcctgggctacccttgggtcctggctccttaggccattcccctgtccctggccccggggaggaggctgccctgctcatggccgcctgcccatcattcgtgactcaccaccgtccccatataccattcctgccctctcctcagctgcagttgaaggctttaactttgcacattttgggatcacagttacatcactgtgtattaaataatcagaataaataaaaattatgcttacagagattttgatagtaagtgaaacatgcagcttatacactactgcatgtataaattgtgtgcaattacaaataggtatggatatatttatatcttatgtacttgtataaatacagatacatacatacacatgcacatcaatgcacacatatatatgcagaaggaaataaatgggaaaatgccattattgtttaatatgtgtgacagcgttattgagttgaaaataaaatacactcagcattatttttaacaaatttaaaagactatttcatgaccttgaggagtagagtcttgaagggcatcttaagatttttaaccttagttgggcatggtggctcacacatgtaatcccagctactcagaaggctagggcagagttcaagaccaacctggataacaaagaccctcgttcttaaaaaaaaaagaaaaaaaaagatttaattagccatgcatggtggtgtgtgcctgtagtgccagctactctggaggctgaggcaagaaaaattgcctgagcctgagttcaacgctgcagtgagctatgatcatgccactgcactccagcctgggcaacagagcaagaccctgcctctaaagacacaaaaatagaaaataaattttaaaaaacaaatccttcataaaaccacacagtgagactgtgctctgcagcaatgccaatgctaaacactcttagaaaagccccacaggggagcctgcttggaaactcaagagagagttgaagaggttttgatccacccaagagattatgtgcgggtaaagccaaaaggaccccagactcgaagatgccagcctgggtgaaatgaaccaaatcaagcaaagcaggcagatgctgtaggccagtcgcccacagaagaatcataacctttcaaagcagattgtgtaaacacaggagagggaggaggaagatgtatcttctgtgtccccagaaacccgcaggcaccggtcccagcgatcccaggaagtgaatagctagtttgttttgggtagctaagaacactgcccactcaaccaaaataagagtgacttcttcaaaaggttatgaacccactgatttctgacagtatttcccaagaaggcaaacagagcccaaagcctgtgcttaaaaagctagtgatctaataaccaaagaatcacaaattaaagtgtcctatatgagccaaataggaacactggcaaaatagagaatttatgcttcatttaatggggcaaagtcacgcccccgatgtgccaggtctgcatgctgttttaaaaattttttgtttagatattttctatgtaaaactaaggttatttcacttaaaattccaattttcagtttcttcctgaaaacatggaagaactgtcaacactggacccacgtccccacatggcattaatccatcaactggcctctttcacttgtttaaaattattctctggttcatttaattttttgagtttgcagcccttgctgtgcatgttccttccctgcttaaaatgtgctgctttcaatgctctgttgcaattgtatataaagtaaaagtaaactagcctggagagacagtcttaagacggctctcctttgtgtagaatacatggactttgttgaccactcttttgcatgatctaagtttttttttttcagcttactttgtaatttccttatggtttcaaaatgctggagaactggtctccaattagtgaagtatttctgggggccttctttaaagttacttgctataccatcaacatagtatttgtatgttttcatttgtaggtagtaggagagatgcttaaacaggaagagacagaagctctccttgttgaccccactcctctcttgtcttagatgccagaaacctatctggaggaggataagcagagcatccatccatgtgcacaccctggggcctgcgcccccccataaatcattatctgaaccaacaggataggctgctgggacacccactctacttatcagagcccagcagttgtgcccaaggcaacagcacctgaattttataattctgcaggtgaaatttagtgcaaaccagatattcctgagacccaacttggcttccgcaactgtattctcaagctgaaaacattttgtgtgaatggggtatgggggcgtggggacactgtttctcagaagccttcattatttcatttctcaagcaaatactggggatggaaatatggagcataattactcaggactttttttttgttttaagaatgaccagaaatagaaccatgaacacttttggtgggaatgtaaattagttcaaccattgtggaagacagtgtagtgattcttctaagatctagaaccagaaataccatttgacccagcaatcccgttacagggtatatacttaaaggaatataaaccattccgtcataaagatacatgcacacgtatgtttattttagcactatccacaatagcaaagacatggaattaacccaaatgcccatcaatgatagactggataaagaaaatgtggtacatacatattatggaatactatccagccataaaaaggaatgagatcacgtcctttgcagggacatggatgaagctggaagccatcatcctcaacaaaccaacacaggaacagaaaaccaaaaaccacatgttctcactcataagtgagagctgaacaatgagaacacatggacacagggaggggaacacacaccagagtctgttggtggtggggaagggagagcatcaggataaatagctaatgcatatggggcttaatacctaggtgataggttgagaggtgcagcaaaccactatggcaaatgtctacctaggtaacaaacctatgttctgtacatgtatcccagaacttaaaattaaatagaaatttttaaaaaggaaatagaaccatggaagcttaagcaaaatgaagcaaaggggaattacttcagttaagttttactttagagcagatgctaaagcaagaaactggggggacatggtttagttggaaggtgatcacaggaagtgtggtgaggaagtagaaaaataagacaggaaaggaaaagaagccagcagcagggaaattcatgggaaggttacttctggggataacagggatttaaccccacaagggccctccaataacagtgtaggacacacctcattactgtctccctgagcagcaaagaagccagggtatgccaacttctatccctcatcattaaagacagttctggggggcatttatttatcccctgccacttcaggtctgccatatgcaggagccaaacacaatcgtatggccagagaacattcttaggcagagagatgcctgtgcttgaggtgagaagccatcactgtgttgggaactgtccatctaagcttcaggtgaccctcagggtgggccaagaggatatgagtggggcatcaacaacatagctacagggaatattctagctcaagtgactgaaaaaaaaaaaaaaagtagctaagcttactccatgcacaggtgaattcaggacccaaaatctgtcatctggatttcgtgttcctccttcttgctgttctgctgccacacagttggctctagttgttggctccaattcttggctccaagtggaagcaagatggtagcagtgattttattccctacatcttttcaggttcacttttaatagaaaataccaagtcttttcccccaggagctcttatctttagagacgcatattgaaaagtatagagatgaaatgataggatgttgggaatttgctccaaaataatctactgtgggtggcgataaaatgaattaagattgtccatgagttgataaatgctgaagctggatggtgagtataggagagttatctctgcttatgattagagttacctctattttcatgcattttggaaaatcatcataataaaaagttaatttgaaaaaagaatctcttttactcaagtttgaggtaaagtctcatttcacctcactgggtcttcctggaccagataaccatccccgaactgttcacagggaccaggagcatataatgaccacattgttccagcactgaaccatatgctccatctctgcaccaggaggaatctctacaaaaagctcaggggctacagctggggagagggcttaacagagattgattacatacaattaccagaagaatggaaatgagtgttaagataaaaaatacacaggttcattccataatgacaatagaaatatagtggacatagaatatctttcctcatcaagcatccattctagttttttactgaagaattgtccctgcttgcccctttatccctgtggactgggcaccccttgtgctaatggtgcacaagtgacttggtctgaacaatgagagggagaccctggtgatgggtgcagagatgagcacatggcactggaccagccaatgataatcttggggcattctctggagcccctcttccttctgaggtggccaagttgaaggatgaacatctgttgtggctggtgttatctttgccatcacttaaggagaatctgccaaagactgagtctgacagaggaaagcggagcccaggtacaggaagacgttctcgaagacattgttatatatctgtattcagccgtgctggaagccagataccctgaactttttagttacctgatcaaataaatgttcctgtttggcttcaggttctcatttagactcctgtcacttatatctctggctaataaagggaactatggtcacccccaccccaccccacgcagcaattgtagtttttcccgccccgatacttgcgacatcaatgtactgctgtgggtacagctctacaagcacctgttttgcaattttcaggttaacaagtaaaatcttccttgagtgtatacctctaagcctgtgaacaatatttctcatccattcatcccctctgaaaatattttacatgcccaatcctctggtaggtaattaggatatagaaattgggcacaatctatgtcttccagtcctggtatggcggagaagaaaagattcaagtagcagacagactgctgtatctaaaaacttgggttcttttcccagctccatcttaaactgtgcagaaagagaattctgctaaactctccccactgctgaataaagtgtcctatgtgaacaggatcctgatggtaaattttcataaccagagactgtcacagaattttagccaagatgagccattcaatattgatttattctacttgatcggaaatcatcagtagtccaattgtcctttctaatggaagatcagcataaacaaagtcacattcaggccaggactcttaagaaaggggcgtgttttctcctcacttatttttctgctgattggaaagaaaagacagtgagatttaggggactggaagagccacaatatggcagaaatctaggtccctgaatcactgcatggccataggaaagctgttcaccaaccaggaacaccattacatcagcaggaagcaaacttctactatgttataccactgatatttgagggcttatttgttatagcatctaccatcatcctttgaattacgaagctaagggaaaaaaagcccattggctttaaaacccagcagaattcagtaggaggaggaagatggagaaagttataaagtaatcaagttgggtgggaacctcaggttagatcctcattacacttagaatgagcgttacccatttgacacaggtggatatctttgctgttactcaaagccaagaggaaggtattttccagctttatttgatgagttgttttcatgcttaatattttccagaaatctgttaattcatacaggtaagagactgtgccttagtcatctctgtagcctccacagcccttcataaacagcagattcaaacaaacaaaagcttcattcaagaaaggaaggaaggcggctttttgtctagccccgtggttctcaacagggaaagattattttttaactttcattttaggttcaggggtacatgtgcaggttatataggtaaactgtgtgtcacagggatttggtacacacatttggtacagattattttgtcacacaggtaatatgcacatagtacctgacaggtagttttttatcctctccctcctcccaccctccgccctcgattagaactatttgtctgttgttcccctccctatgtccctgtgttcgcactgtttagctcccacttataagtaagaacatgtagtatttggttttctgttcctgcattagtttgctaaggataatggcctctggctccatccatgttgctgcaaagtacatgagttcattctttttatggctatgtagtactccatgctgtatatgtaccagattttctttatccagtctaccattgatgggcgtttaggtggattccatgtatttgctattgtgaatagggctgcagaatacatatgtatgcatatatctttatataattatttatattcctttggggatatactccataatgagactgctgggttgattgataattctgttttaagttcttttaggaatcatcacactgctttccacaatggctgaacaaatttacattcaactgggggagatttttaccaccaggaaatgtttgtctatggctggagacatttgttgtcacaactatggactgctacctgcatttagtgggtagagtccagggatgttgctatatatcttacaatgcacagaacagcccctcccacagcaaagaattctcctgctcaaaatgtccatagtgccaaggttaaatcttgatattataacctaaggttcccatcccaacttgaccaattaatcattttataactttctccgttctcctatttaacctactgggctttaaagccagtggccctttttcttagcttcctcattcatgaaacagttttctggggaggccctagaattttacctctgtattaaaatgatctctattttcttttcattaagggaaaaatatacaaggggggtggatgcagggggcaaggagtgggtaagcagaccagaaagagactccacattaaaacacacaggaaaacagatcttctctctggaagacacctgcaatctctttgtttcctttcttatattaggtcttccgcatggtcaaggaaagagacccactccagttagttcaagagaaactgtttattgtaaggacacatgcagattgctaccagaagccttcatattctctccccactcccctgccccatggtcccctatttccactcccctccagtcatccccacactgtcctcctcccacagctgtcccctgatccttcctaacttcagctcattgtggcatcttttcagcccctgtatccacgatgctaactgaaaaatcctattctatttctaattcaaaagcccacatttaagctcatcctttcaaacccagccacagacgtcaaatttcagactgaggactggatatactttcatcggtccaacactcttggtcaaagcagcaatccacagcaagaagggtggggcaaccacaaagattggcatctctgctacactgtatcacacacactcctacccctgactccgagtgacatcaaccacagacagttacattgagctacaggaaggattaaaccacttccaagacccaggaggtcccctaatcattttgccccatgtcttggctcacacccctggaaacactgggggaaagtcacctaccttgtttggggacacctttttagaggataactcttggtcctcaagcttagaagctgttatgaggaagacgttggggcttttcagaataacatccgaagattaccccacagataccttctcctctggaatcgctctcaacagtgtcaggcagagccccgggagcccacacatctttctctgtgttcttgtgaccatggaaatcaggcaggtctcaagaaacaaagtcacaaaggcatgagctcatcatctattttcataacactaatgcaagagacctccaacacaagcaaagcaaaggcaccgactgggtgcagccacatatcatgagtttccaggccattctgcctgagttgagatcattatgctgcttctttcattgcacaggaacgtgggggttttctctaaactatgactcatagcaaagcatacaggcaatcatgtagagaaacctgttctccccaggaaaggagggtgagcaaatgctaaaagttttgatactttaatatagcactggccttggctaattttacttaatatgaaagatttcaaataatggaaacactgacaggcaaaaacattaaaagtttgcataaaatctcaaaaaaccctgcaaacaagagagaagcatggtctaattaaaataaaggaaaagattgctactgggttcctgaatactcttttcacaaaggcttcacgtcagatgaacttcaagcaccaagcagcagggatcccactgaagtttattcagcgcccttctgggcactaccagctgtgaaactggtaacctattgacaaataggttatttttccagctgcacccatattcaagagcttgaccagcaaagtcccctgataatatttggccatgagtcagaatgtattaggcaccttctgtagccagagccaaaaaaactctggctacaggagaaacctggcactgtgcacaagatccccttttttagcatcagctgtcccctttgcagtttgttaaagctggaggagttttaatccaagtgaactctctttcaggaggcttcggggtaaggaagctacaaaagcggggaggtaggggcacggctgcaaagtgatgaacattgcagcaggttcggctattcagaatgagctattttctcccaaatcctgtaattgcctggagcacgtgatctttttgaaggtcattagaggcatgcggctgtcagatctctcccagaaagtttcgctttgattagttagttcctgatgcttatttcctaaaaggctctttttgtcccccacccccccaaaaaatggggagcattaaaattttaaaaaaggaattagatgaatatcctgctaaatgtaacttggcaagatgaaaggaagtagcaaagaaacatgaaaagggtgcagaccttcttgggccccctgctggagagccaacctgagggaaattgacgcacgatcagcatattccttccccaaaatgaggcgactcggaaatacacaatatcaatcatcatctatgcaaccactcattattttgactcaaacagaacgacatacatcattggtaaagcccacgtggacatttccaggtccctggggcatttataagctgggaaaggttaaaaaataaaataaaattctcttttttaaggattccgatgtctaagaaagcagccatgaggacctaataaagaactagagctgaataagttgtccagtgactatgatcaaatatacagctagcaatggcaatgtttcacatcaaagaagaaaatcaaagttttttcccagcacagggagatggggccgatctctcttggatcaaaagtcctttttgtcctctcacatttgcagatgtgtaaattccaggcagatctaatgaaggagttaccttttcaatccctagattgtgtttgccaaaacttcccttgcaatagggacactccagcaaccctggctcggggctccctgcgtacttagatgtaatactatgtcaacaacatcctgcaggctgaagcagcctcttttttttaaagccttggatcaactatgcaagctcaacttgcttttatttttgttgaaaatactaaattcatttgtcatcactaattccctcaagcaaaggaacagctcctcgttgatgccatagtttgcaagatactgaagtcgcacgttgtttctaagaacactgatgctctaaatctccagcttttgacttcaggaaaatggcacttactttatattcatagaatttctggggcagttcttctcaaactttaacatgcacgtgaatcgccgagggatcttgttaagaggcagattctagctcggtcagtctggatgggacctgagattctgcattcaggttcccagaggatgtcaaagctgctggtgcatggaccacactttgaatgatgagatctgtttagctggttggtaggtacctggtggctgagctttcaaactctgtaatcagactacctgggtttgcatccagcctccactgtttaccctttcttactgtgtgcctcagcttccacatttgcagaatagtgctcaaaataacagtacaaatagagctgctccgtgggttacagaaagctatatgtataaatcactcggcacagtgtatggcacatgagcactcaagaggtgagctgtttctgccctggtgtaatcatccctcacagagcccttgttcccaccttctttccaggcagtagaaagccagaatagtctccagagacagatgaagtgaaattgcaagcttctgactctcacaactcaacccatcagcttaggttgttaaaaaagcgaggtattgcagtgcactatattgtcatagtctgagaagggccgtgtgcgtgcccttgtgtgttccaaaacctaggccacgatgtatagggaaaaaagagcacaggtcaggtggcccagggagcaaactgacctgtgagatccttcgtttgcttacttacaacattgggataataaaacctaccatgtagggatactatgaagatcagggatcatgtatgcaaagtgcctgccctgtatgcagtagatgctcaataactggaggctgttatgcttgtaatcaaaatcctatcctcccaagagcaaacaggagaagaagccaacataactggcaacttagccttgataactctttgtttatccgggcaagcggaaaagggcaggattccttggtgcttgggtagagagcttttccatagcctcagatacagacaggggcactgaaattatggggtacaagaggtttttccaggtggtccaggtgagacggagctgggagatggcagggaaagatacagtcacaattgataactagagagctatccattcattcattcattcatgatatttataagttggcccgtgtgtcaggtgttgtacaagacagagcagaggccccactctcaaggagcaaccatttcacagaagagacagaaacatgtaaatgaacacatacaagttaaagttgtggtacagctaatgacatgagggctcctatggaaaaggttagcaggactgtcacgaagccctctcaaaggaaatgccccaaaagccaagttgtgaagaagtcatcgtcaaccagtgcagaatagtgggaagagcattccaggcatagggaaccatgaggacaaagcccctagggttggaaagaacaaggaggaaaatgacagcaaacaaagccccaaaaaagcacgtagtgcccaaatcatgcagggtctcttcataggccatggtgaggatgttggattttattccaaaggctacaagatgccatgaaagggttttaaatctgtcttacaaaaccataaatttcacactgcagcaatcaagtcccacaatgtcctgaaactatggagtcagaacttgacctcttgacgccttctacttcttactagagattcaaggtctttgaccctggtgacacaacaccagtacgggattttttcaaactttttgcatttattgtcgaagaagcaggggcagcaaagaatatttggctttccctggaagtcccaagggatgctggacagaacaaccccaagtggaaagacccttgttaggagaagtcgagtaaatacactagtgagtagaccattcctccactacaagctcagcactcccaaggaataagtaaatccctacttaaattgcctgggaggcctccctcaattacacaaatctaagacatgacagggtacagcagagattctcctacagcaagtctgaaggctgagagcaaagcaatggagctaaggcatcatcctcatactgctcatggtgggaggaaaaaaaaaaaaaaaaagactgttccgagtctcccctccctggctgttttgctaagccccaggcctacaggaggctggatggcccaggggaagaggctgccttgcctaccctgggaaagtggatggagggtagcttcttcctctgccaagaaaatcaggcgtcctacagggagagagagctgggggtaaaggctgggtgggaggatgcttaagggccagtctttccccaaactcagctccctagagtacagcgagttctctcccactcagagcagaaggaggtctgacacactcacacctgcaggaaaactgggggccaggaggtgggagacaaaatgaggacacagacaggaggagccccagactccttcctgactccctgccttcaccagaatgaagtagggaggcttagagctccttccaactgcactgttttgcttactgaattttcattttgcttttcttaattataagaataatgcaaagtcccatcaacaacatttttgtgtgagttgatggatttctttatatatatatatatttttttttgagataggatctcgctctgtcgcccaggctggaatgcagtggcacaatcagagctcactgcagcctcaaattcctaggctcaagtgatcctcctgcctcaggcttccaagaaacagactacaggcgtgcaccaccacacctggctcatttaaaaaaattattttttgtagagaggggggtctcgctatgttacccagactggtctcaaactcctggcctcaagcaacactcctgccactgcctcccaaagcactagaaatagaggcaagagccagtgcccagccagtttcattaccgtatttcaaatattttgcagtattggcagggtttactattttcttgggcatctattagccattgagtttttattctctaatcacatgttactcatttctcttccatttttcttttagggtgttttgtctttttcttaatttgtaagtcatctttgtgcgttaaagatagtaaccctttggcacgtatcaccaacgtttttccctaccatttgttggtttctgttaattttctttatgttattgctggaactccctgaaacgaccacaaagcaaccatttgattctgccaaaaatattgtctttgaaatatggtttctagaacgtctgtgagtcacctgctcacatgtccaagatgtctcagaaatccttctgcttttataaaccttgtcttttggcctacagcaccagtctacactttttaccagctctgaggaccttctgagtcacactctgaagtcctgacctcaccataaacaaagagccttttctgggggagttggagctgccctaagccagtgaaagccaatgctcacacgcttgccctatccaactgctttcattagctccattctttttagtctaaaagccttcctgacagcaacaggggccaagaatttctctcatgaaccccattttcttgatttcaaaatccacttgccttgggagaaacgcttgaacctgggaggtagagattgcagtgagcagagatcgtgccactccactccagcctggcaacagagattcagtcttgaaaaaaaaaaaaatccacctgccttggtacaagatgggaaagtctttgggtgtttattggctgtatgttcaagatgaatcacctgtgagctgtggcatccatgaaaatgtggagctccttaccatcctcaagaactttctcaccactcaacctctgcatgtgatattcctccacctaaacactacctccctacccccatactccaccctggttggccaacttctaatcatttttccaatcttagcctaactaccaccgccctgggaggtcttcaccagcaactgtgccaggcacccttgtgcaccaagagcctttagtatcatttctagcatcatggtatatttatatataagaataattgcctgtttatctgtctccccagcctttttatagcatgaactatgtccttcaccactgtatccctagcaactagcacagagcctggcacctagctcacaatcaataaatatttgtggaattgatggatgaattcaggcactggaagcaagaaaagggccagcaccaccgctatctacgtaagtcatccataccaagagtatcaagttgagctcttccatagtaaagaattaaacctcgcccaaaaagaagtctggtctttacccttggtgtcttactaagccctgggaatgtcatgcctggataggagtgtttttttgcttgtgggggccttgggtcacaccagagagtctaacagtgtgatttagagtgggggcttagaatcacatagcatgagctcaacctccagaggacctggaagccaaggtcacccatataagaactcaacagcagaccccaaaaaagactctgcacgccaaggctcagtgagcttcccttgttggcaacgtcccatgcttattttcatccattgttgctgagaaggtggcactgtccatgattccgtaggaagatcaccactggcagctcacggttggacctttcatgattctgcctatgtgtccctcttttggctgattttagtctgtatccttcagctataacaagccatagccgtgggtgcaacagcttgcagcgagttttgtgagtttccagtgaattatcaaagataagggtggtcttggcagccctcaatcttccaagtgatgtcagaaatgatcgttttatgaactgtacccctcaactttgcagctacacacttaaggacattctgatggaaggagctgtaatattaacctatctgggaagtgtgaactgtaaagaagaggccattacagaatgttgagattggccaaaccaccactgtagatgctccattcactggaaccagccttggaatgcagagggctcctgccaccccactcttctaggctagaggtgggcagcaccctccaggcaagagcatgaatcatgtgtgcctgcttgctgctccccctctctccaacagatgactgggcaaaaatagaagagaatccctcctttataaatatctttacatgctaaatgtctctataaagcaccatgcgccaagctaggctgctaagaaacagatgcaaaacagatgcaaagatccatgagatagctgagaagttaaagaattttaattcaacaaaaggcaagaaaagtttcttaggagcataatacagtcaagggaggcctgatgcaactggagagtcatagaaattctggctcccagctattaacaatagtatttcttaccatggcagtttcaatgcacatatgtgcacgagtgtgtctgtgcatacctgagcacgctcttatttcatccccgtaaccaatctttattcatttaacagatatttattaagcacctactatgtgcatcacttttttttttaagcacctactacgtgcgtgacttacttttttaaaacagggtctcgctctgttgcccaggctggaatgcagtggcacgatcagagctcactgcagcctcaaatttctgggctcaagtgatcgtcctacctcagcttcctatgtagctgggactgcaggtgtaagccatgacacctggtgaagtcattttagtttttagtagagacaaagtctctctgtgttgcccaggctggtgataactctcttaagatatagaaatgactaatgtccctgctttcaaaggacacatgctttaatgggaggagtttgattaaaaaaaaaacaaaacactaaccatataatacttagatagagctaagctataggagaaaatgaagctgagtaatgggctaatggctagagtggaggctacttgaacttggatgatcatgaacagcctgtcacagtcagcaatgtttgagacgaaacttgaatggtgagaacaagacaaccacagaaaggtccaggggaagaaattcccaagcaaacggaacaacaagtgcaaaggtgagtgtgaggaatgttccagaaagataaaggaccaagggaaaagagagcaggatttggtctgagatataagcaggagattatggtgctccttctaggccacagcaagcaattgattttaattctaggtaaaatggaaagctggaggaagattttaataaagatgcatgtgattcaagatatgggttttgtcatcgttcttactcactcgaccagcgaggtcatgcattgatcataggatgtcaaagctggaagaagataccagtttagaagatgctgctgtcactgaatgcagatttcataaggagttgcagtgaaggtagaagcatgtttcatggatctgtgttaagggcagagctagaagcccttgctgatggtttctacatagcaggtaagagggagagagaaatcaaaggtgacttgtaggtttgtagtttgaacagctagatggaaaatgaggtcatttactaagacaagaaagtaagaaggagagataggtatggggacatgctaaagacaatgagactcagaaaagccaagagactcattcaaggttacatggctgggaaatgatagaggcagacttggaacgctggtccctgggactccacggcagggttcaaatggtaaagcaagctgaatttccaggccaggttcagggaaacattgaggggaaaatcaaatcagtaatccaggcaaattcagggcataccacgtggctgatctattttcagcatccactcttgtgaaggctacttgtagaatcttagaattaatagaattttcgagctgagcagatctttgggctcaaaagggcatctgtgcctttgcaaacatgattcaccgaacatcccctgagtaggcagatgggtcaggctgctgagtagactttaaatggagctccggacacagacccatcttccaagccatcctattcactttctccccactgtcaaaaggaacaggacattatataaaccttctgaaatgccaaaaggaggaattctatatttaactcccctcccagcatccaaacatcacatgatggaatgttgaggatctaattcaacaatgttgagtaacagggatataacccaggggactctctctctccttctcgcttctcctgcaacttctcgtctccagccacccactgtcatgtcttcattaagggagttcgggagcagcctgactcaagcaggtccccaggaaagtaaacagctgggggagtaaaatggattgtgctaacatataatccatagctgccagggagctggaactcagagccaaacacagactcatctcttcagctatcctgagaagtgtggggactgaggactaagagggacagaggcagcaatataaaaaccagtgccctcaaggttcaggaggcaaatgaaatggaacttaagcttctgcatctctgcagtcgggacttttgttagaaaagcacttaaaaaattcaaggcacatccacaagatttcaagagctggcatgatggaaaatagcggcaggggctgatcaagatggcatggagtgaggcttctgaaaacacttattgaccagcttgcatgctgtgggtgatcgataaatattaaacaccgaggctagtggagaacaggttttaatgaggcccagaacagcatgtagagtgggctgtagtagtgaggggccatggagatgctaagcaaccagtctcatgcctgcaggtcccccatgtccatgcttctccctaggctgttctcagttacaaagacaaagcaaaccaactcggggggaaattcatcgggaagttggaagctaaagggtccctcctagcatggccaaggcctgccgctccagtctcttctcaccacttatcccattttttttttttttaatgctcagggtataacaataaataagagagggacagagagcacctctgctctcggagtttccaggctactgagagaggcttcaaatgcattgacaagactagagtaggaaagtaccttctgtgataggccctcagagaaagggcgtctgtttcagccaagaaggtcagggaagacttcctgggagacatggcttttgaatgggattagccagtttaagaggtggggaagaacatttcataggcaatggcctgagtgcctgctgttctttttgcttgtaacacacttgtgcccctgacccaccatggatcttgtattctcttcactaatatccctctgcctagagtggcaaaacaggaagagtaattcgccattattattagcatgttattattgttattattactactactgttattattttacttatgagcgcttatgatgtgtcaggcactgcactaagcattttaccaccattattctcctctaagctccatatccctaaaaaaaagtattataatccccatttataagtaaggaaactgaggttcagagatgtgaaatagtctgggcttggtggctcgcgcctgtaatcccagcactttgggagactcaggcaggcagatcacttgaagtcaggaattcaaggccagcctggccaacatagtgaaatcccatctcttctaaaaatacaaaaattagccgggcgtggtggtgcatgcctgtaatcctagctactcaggaacctgaggcaggagaatcgcttgaacccgggaggcagaggttgcagcgagctgagattgtgccactgcactccagcctgggcaacagaatgagcagaacaagacaccgtctcaaaaaaaaaaaaaaaaaagatgtgaaataacttgtccaaagtaaactcagccagtaatgggtggcaaagctggatttggggccatgcaacatgtctccagtgcacctaaacaggtgctataccacttaccactaggtcatcctacgtcaaatgtaaagccacacattgagctatgtcgtgatggctttctgacctaactcctcatgtcccttgacatttatcatgcaagagctagtccataggcattggaatcattcgggcatggggttaaatcccagagccaccactaactagatctgtcattttaagcaagctatctgaactttcattgcctcggtttccacaaccacaaaatgggaatttagtacgtatgtcctaaaggactgcagaaagaagcaaaataatacgtctaagcagtgtagcagaagacctggcacttaacagattataagtttcccattgctgctgtaacaaattgccataaagttagtggcttagagtgatgtaaaatgtattaaagtcctggaggtcagaaacctaaaatggaccagcaggccttcctagtgcttccttctaaggctttagaggagaatccatttcttaccttttccagtttgtagagtctgcccacattccttagctcatggccacatcactctaactctgtttccatggtcacatctccttctctgactcttccatgcccgcctcttataagtacagtcacaattatattgggcccaccagataattttggatgaggctctcatctcaagatggatccataacttaatcacatcttcaaaatcccttttgccataaatcataacatttatacaggagtcagagtttagaaggtgaacatctttgagaggtcgtagttctgcctgccaggccaccatcttgctccgaaagattcactccatctccccaaaactaactcacgatagtgtcaaagtccaaaattttcatcaaaatctcatcagaccaggcacagtgactcatgcctgtaatcccagcattttgggaggccaaggcgggtggatcacctgaggtcaggagttcgagaccagcctggccaacatgatgaaaccagtctctactaaaaatacaaaaattagccaggcacggtgctgtgcacccataatcccagctactctgaaggctgaggcacgagaagcgcttgaacccgggaggtggaggttgcagtgagccaatatcatgccactgcactccagcctgggttgacagagtgagattcagtctcaaaaaaaataataattataaataaataaataaatctcatgagctcagatgtctaaaatcttatctcaatcacctaagtcaagtacttataagaatctgagcatgatccctcctgggtcaaagtttctctccaactgtggacctgtaaaactagaaaacggattatctgctccccagatgcaattgtggaacaggcatgggatatcagttacaggggtttttgattaaaaaaggaatcaatgaaaagaaaaaacaagttaccacatccaaacaattttggaattcagttaggcagtccggatgcagtggctaatccctgtaatcctaacactatgggaggccaaggtggttggaatgcttgagcccagacattggagaccaacctggacaacgtggtgaaaccccacctctgaaaaagaaaaaaaaaatacaaaaacagattagctgggtatggtggtgcatgcctgtagtccaacctactcaggaggctgaggtgggagaatcacttgagaccaggaagtcgaaggtgcagtgagtgatcacatcaccacactccagtctggccttcagggtgagacactgtttccagaaaaaaaaaaaaaaaaaaaaaatggagaggagagattcagttaggcaaacattaggcttcaaagcctagaaataatcctctcccatctctgtcctttgagcttgaggctctaccctctgagtaaccagtcctttctcatgaagggtaatatgtgtttccagcctaagagttttaaccgtcatttcctgcctgtagaatttggggagtatatcataggtgataattgaacaatgagaacacttggacagaaggcggggaatatcacacaccggggcctgtcagggggtagggggctgggggagggatagcattaggagaaatacttaatgtaaatgatgagttgatgggtgcagcaaaccaacaggggacatgtatacctatgtaacaaacctgcacattgtgcacatgtaccctagaacttcgagtataataataataaaaaaaaaatttagggagtgtaatggccttccttcattttatcttctctgttcccttctgtccaaattgccaatgtttatgctggtaggaaatttcaaaaaccttatgggtctcctgagtatgtcatggggattcactccatcagacaaaaaatggttcttcacagttctttcctagataatcctaatatctattctttgcttctgatttgatggccaaggggtacatgagtctcatacctaatctcttcaaagagcactctgtgtggctgaatactgggactttttatctttccaacgaactagcaaaaaaaaactgttcagccataccctttcctaacatgctttcctgatagtaaatctcctaattttagcatcttttgcaatccagataggctgagaatttcccaagtcatcaaatcttgctttctttttgcttaacagttcttgcttcaatctctttcctctcacattttactaaaaggagcaagaagaaaccaggctgccccttcaacactttaccaagttcattgcttgcaagttcagatttccacacaactgtagcatataattcagataaatgctctgccactatataacaaggatgtcctttcctccagttttcaataacatttccttcgtaggtagccctccctggtaatgcttttaacgtccatatttccaccaaaagtctgttcatgatgatttaggtagtctctaaaatgatgtatgccttctctaacatgtttcttacttctgagtccccagaaacagaactgttagcattcgtatttccactcacagtctgttgaaggatgtctagtctttttctctgatgtgtctccaaattattctagcctctgcccaacacacaattccaaggccactgccactttttaaggtatttgttacaacagagccctattcttggcaccaaaatctgtattattgagggttcaattaaaggaacagatgagcgggagacatatattaagaaatacatgacaaggaattggcttacatgattgtggggaatgggtaggtaagtccaatatccacagggcaggctggaacttctgggcatgagctaaaccttctctcctcaggtggaatttactcttcagagaagcctcagctctactcttaaggcatctgactgattgaatcaggcccacccagattatctaagataacctcccttaaagtcaactgattataagctttaatcacacctacaaaacaccttcacaacccacctacattagagtttgactgagtacagactgtagccccatccaagttgacacagaactgacagttgttgcattcatcatactccgtccctaacactcaagacagcttctcacgcattcctctatctcctcccctggggccaaggtccagataagcacatgtaagttaagtgagcaagtctaaaagcagatgtgcttatcctttcaatcactctacttttcatcactctcccttttacactctgctccaccatccaaccccactggttctgaaggtttcctattgaaccaccctcccagaaagcccatcatcttctgctttggaaagccaatattgtaaatattggaagcataacttccagcacacacaaacacacacacacgcaatatcatcccacctcttcaacagatgaaggcgaaaacaactaaaatccaagagtaaatctccagctaaaaacaagctcaaatagcaacaaaaacttcaaggaggagattcatttgcaactaggtgctaatgaaaccaggtcctccttccaagaaaatcaaactgtgtaactcagaatagccaatttaggatgcaagaggcatttggctaattatactcaattgtagacctgttatccatggtgttaaacaaggactaaaggttaaagatactgattaataattaataaactatctcattaaaaaaagaaatcattgcaatattttgctctgcatattctaggtgaccttttcctcccccatttttcttcatattttggatgaatttatctgtcagtggaaatgtcttgaaagaataagttcactccaccttcacaaggatggtaatgatgatgatgtttatagcagctaccatttatgggggaactgaccttgggcctcacgactgtgctaagcacttaacatacaatgtttcgttttatcattattatgacctgaggccctgaaaaagaatttgagctcccagtggtttgagaaatgatcccaggaaacactggtaagaggaaagagaagtgagacagggaagtaaaaggaaacaataaatggtaaattttaaattaagtgactgcttaaggcaactgggccttaagatcactagagacatctgggatatagcatgaaatatctactctacatcacagttatcctgcctacaagacaacggactggagtgcttatccacaaatccctaccgttggctgcttccagcaccttcactccccctgcaggtgggctaaacctgcttccaaagccagaaaagacagagtcggaggggttcacagtgagcaagcttcagtatatggaggcaaggactgggggcatatgggaaagccccaacagcacatgctacataaccctaataagtaggtggtaccaccctcatttaaaaggagaacaaaaatgaggctcagagaagataaagtaacttgcttaaatgaggaggctggattgaaagcaggcctgactctaaagtcacattcttgccccctacacatgctgacaggtgttcctattttctccatcttagtttgagccatatcacccacacctggaggtctgcaatgacctaatgctttcacctgcctccagtccttcctgcacactatggacaatttcatttcccttccttagctacttacaaaacggaggacgaagttcaaactccatattcaggcactcgattattcccgtcagctggctgtatggccactgtatgccttcctgccccagccctggcctacatttccttaattcaactcacgtgccatttttcttcttttcaataaaaattcactgtgcacctattctgtgtgagacactatagtttcctcctctgtaaaatgggggtaattgtagggttaagagcattaaatgagagagtgtgacatgcttagcacaaagtaagggctgaagcaatgcaagcccgcattatgagctcacccaagagtcatgactttatcctcagagcctgggatgcaccacatagtacttgtcataaactcctagatactgaacatgatctctctgcctctgaggggccagctccttgagataatgggctgtacagtctgggatgacagaaagaaccttgggcttatagccagaagccagattccaaatttggattttaccaatccctggccatgagactctgaccatatgaatccactcctagaccctagttctgtcatcaccaaggtgggcatggcactttcctcttggcattagtagaaattaaaggctctgtagataatgcttcatgaaaagtgggctgtttccatcaagcctaaatcatataagtgtgtgagatggttaacactgaagactcagaagtcagagagggctgagtttgaaaccacattcgatcactattcaactgtgagactgtattggttcattttcacaatgtaaagaactatctgagactgggtaatttataaggaacagaggtttaattgactcaccgcttggcatggctggggaaggagacctcaggaaacttacaatcatggtggaagacgaagaggaagcgaggaacatctcacacagcggaaggatggggatgggtagaaaagaagcaattgacacacacttttaaaccatcagatctcgtgagaactcgcttactatcacgagaacagcaaggggaaaatccgcccccgttatccaatcacctcccaccaggcccctccctgacacgtggggattacaatttgagatgagatttgggtggggacgcagagccaaaccatatcagagacactgtgcactctgtttccttctatgagcctcagttttcccatctgtcaagcaggggtaagaatagtgccagcatcccagacttactgtgaggattaaatgagatatttaaagtacctggcatagtttcttgcacataataaaatttcaatacatgccaactattatcattatcattattactatgccatcattatcagaatgttttgaatatagaattgcttgaggatagtttattgaatgatgagtgaattaagtgctgagagaacatcatccactaaggtctgagtacctagatttcagaattcttggtatgggagttctccagtggggaaacaaaaagccttgcaattaagaaaactgaaaaagaacagaacaggcttggcccagttgccgaagaccagtcgtgtgtgaaatgcctcagaacaccggatggagacagcacggatcaagccaagtaaaaattgagagcatgaaacagacagccctggaggcctggaatctgctgaggccatttcttcctgagacctaggggtggaagcttgggggtcaagtctgctttgagaggcaagatctcaggctgtgtgcagaacacttttgcacctcgtgtctcagtgatgggaggtcagggtgagcttccccaccaaaccccaacaggtgtttattataccctgtggggaggcagggagaggagagggaaatgtctcttctgaagaggcctagggcaagaggggcagctgaaagcctcattacaatgaaaacagaaaatagatcaaattaaaagccaattaaaaacaaaagccaatctgcttccattgttaaaatccagattccagttgtctgtctgtagggtttggcctgtgcaatttaaacaagacatcccaggggatacagatgtggctgctcacacttagagtagtaaggccttggatgttacttagtccagtgtttccagactttctttacgataagaatcacctggggataccttgttaaaaaggcaagtatgcaaccttacccaaacatactgaatcaaagtggggtggggggaatacccaagaggttgtaagtttaaagagctcacaggttatttttaatatcagagaggtttaggaaacactgatttggtctgtatcaggtgcagcaaattcaaatatgtgcagaacccagagagatgagataaataatttttttttttgaagggagtctcactctatcccccaggctggagcacagtggcgcaatcttggctccctgcaacctccgcctcccaggttaaagtgatcctcatgcctcagtctccagagtagctgggattacaggcacctgagatccagtaaatgagaaataggaatctatagccctgctgaacatttcataaggcctggcataattcaaattctgccctgtaatcaggctgtcccaggcaacacaggcaagattaaagaaatatttaagtttatttgctttgggctggaatatatataactcagtgtagttccactggttaccttatgttctgttgatctgcatttctaagtggcaattgattgtatgctgttaattcatttttttaaataaaatcgattagtacttaattaatgtattttgttttgccggcaaaacacacagtataccatgacgataaaaagccgcaggataagaagagtccctggtgaagaaaaggtgaggaacttcagaagaattcaggcccaaatctctttcaaagatttggaaactgggttcccaaaaagagagttgacacatccagggtcggagtgatagtgacacagtcaagactagaatccaagtcttccctgactctcaatctagtaaatttttctattataattcaaataggtagcctatgggagaatgagatctttggttttctctagtccagaaaacactctttcttctggcacttttggggaaccaactgtccccacttttcattccatgtagctcaagtggggcaacttcagcatctccagctctcaggatatgcacatgaccagcctggtcagtcagtgtattcctatcctgaacaatgtgattggttgatttatgggcaagtgaggaagaggagtccaatcagagttagccctgggacttctgatgaagcgaccaggaagtggactctgcactctgtttcccctaagtcacttaactgacagaataaagatgcaacacttctgctagtgactgtcttgccacactgggagttggggtggggagacattccctgaataaagtcaatacaggctgggtgtggtggctcctgcctgtaatcccagaaattttggaggccaaggtgggaggactgcttgagcccaggagtttgagaccagcctgggcaacatagtgagaccccatctcttcaaaaataaaaataagcaaccaggcatggtggtatgcacctgtagtccaagctactcaggaggctgaggtgggaggatcgcttgaaccccggagggtgaggctggagtgagccagatcgtgccactgcactccatcttaggagacagagcaagacactgtctcaaaaaaataaaaaataggccaggcacagtggctcactcctgtaatcccagcactttgggaggataaggtgggcggatcatgaggtcaggagttcgagaccaacgtggcaaatatggtgaaaccctgtctctaataaaaatacaaaaatagccaggcatggtggtatgtgcctgtagtcccagctactcaggaggctaaggcaaaagtattgcttgagcccgggaggcagaggttgcagtgagccgagatcatgccgctgcactccagcctgggcaacagagcgagactccatctaaaaaaatgaaataaaataaaataaaaacacaatgaatacagagaagaatcaaggggaaaagcaggagagaccaaatccaaatgacacctggatctagccaggctggaagattcctgctcttttcagttacatcacccaccttgtctgacttcctacagctgccattggttaaaaacaaccataatgccagaccttttcatatatttctgttgtaaaaattgagattttacagatgatgttcatttacactatggcatgccatcctcagggcacctctgtgaggtaaataggccaagggctattttccacattttacaaatgagataccagagctcagaagggaatgatgcattgccaaaggtcacactgctcaccaacagcaggacagggacaataaatctggtcttatgactccagctgagagtgctttccaccacagcactatgtctaacctggtggaaatgcagcaacttcaatcctcacctgcctcaacttaggagaagcctctgcctctcctatcacactcaacagggatatgtttcttgaggctgatgccagctcaaagcttcattgcaaaattcttccaggctacctgttctgagttataggaaatatcccaaagcgcccatgtcctaccattccagggtacaaaagagcacgaacccacaagaagatattggaagatttactgagccacagggaaatgaggaaatgagagcaaagtaaggaagttatataagggtcacacacacacacactcaaaaaacccagggttaaggttagctgcagcacacagagacttgcagcttacatttagggagacgaataagtttaaagaacagataaattaaaaagactaaggctccatacacgtcagagccctgacttaacctcaaccatccaggctcaagttaaaccaacgaaagtgaccaggcatagtggctcatgcctgtaatcccaacactttgggaggtcaaggcaggaggatcaaggccacaagttcaagaccagcctgggcaacacagcaagaccctgtctctacaaaacatttaaaaattacccgggcatggtggtgtgcggtggtgagtatagtctctgctactcaggaggctgaagagggaagattgcttgagcccaggagttcaaggctgcagtgagctgagatcatgccactgtactctagtatgggcaatagagcaagactctgtctctaaaaacacaaacaaatttaaaccaaccaaagacaccctaaccctctcccatttccacctagcttctctcaagtccctgtctctgaatcagaccctcttgctatgatctctctcagtcacattcccatgtaaaattctcgggtctcatcccttttccaattaggtatttaatacaactctgatcctggtgccaccacataataatttacacagaacacttaattagcttcttagataaaaataacatgtaatttgtttggtaattatatgtttccacaactgctgaaagcaactcattataggaatttggtatacttaggatagattaccttaattctattttctgtttatccaattagatttgccggtcttaattgtactataaattgtgttgagctggtgaagatgactatgaagttgttgttccttcagatttcatggttggtatgcatgtcgctggtgtttgctccaggcactgactaactctgtctgggttgtgaaaacaaggacactgtaagacctttcatacctttcaaagaagaaagtggacaacgccttccgctaagggcctccttaacgtggtgtattccagtgtgtggtatactgatggtgtacaagatcattttagatggtgcagggatacattttcctcttaaattttcaaaaattcaggagccattctactatattaaaaaatataaatagcatatctgaaccataatttcaagcaaattattgcttgaaatgaagcttaagtaggtatttatgtttaaaaaccttgagttatttaaggatagttgatgatattaaggaattattaattaagaggaataataaaattgtatttatagtcaatacaggagttcttttaatatacttactgaaactttaaattaaaatgatataagttctgagatttgcattaaaataatcagggggttggtaaggtattagggaggagggagtattaagaaaacaagattgggcagggtgcgatggctcatgcctttaatctcagcattttgggagaccaaggcaagtggatctcttgagcccaggagtttgagaccagcctgggcaaaatggtgaaaccccatctctactaaaaaacacaaaaatgagccaggcatggtggcacacacctgtagtaccaactactagggaggctgaggcaggaggattgcttgagctcaggagatggaggttacagtgagccactatcacgccactgtattccagcctgggcaacagagtgagactctgtctcaaaaaaaaattttttttttaaataagattgtccccaacatggctctcttggataatgccataatgaacatgagtgaacatgagggtacagatatttctttgagatcctgatttcaattctttgggatatgtacccagaagtgggattgctggatcataagatagttccattacgctggtgctattacttttaattgcaaaaaccacaattacttttgcaccaaccgataataaaaatttaaaaatttttcgaggagccgccatactgtttttcatatcagctgcattattttacattagcaccaacagtgtacaagggttccaatgtccccacatccttgccaacacttgttatctttggtcatttttataatagccatcctaacaggtgtgagataatttcacagtcactcgttgtggttttgtgttgcatctccctgatgattaatgatgttgagaacctttttaatgcctgttggccatttgcatgtcttctttgaagaatcatatatttcaagtcctttgtccattttttaattgtccatttaataattttcactactgagtcataggaatttcttatatattttggatattagccccttatcagatatataatttgcaaatattttctcccattctataggataccttttcattctgttgattgtttcctttgcttcgcagaagtttcattgcagcattattcagaacagccaagatacggaaataacctaaatgtccatcaagagatgaatggagcctggccaacatggtgaaacctggtctctactaaaagtgcaaaaatgagccaggtgtggtggcacacccctgtaatcccaactactcaggaggctgaggtgggagaattgcttgtacccaggaggcggagactgcagtgagctgagatcgtgccactgtactccagcctgggcgacagagcaagaccctgtctcaaaaaaaaaaaaaaaaaaaagagagatgaatgaataaagaaaatgtgacatatttatacaatggaaaattgttcaacctaaaaaaaaaaagaaaaaaaagtccgctatttgcagtaacatggaaaaacctggaccattctgctatgtgaaataagaccattacagaggacaaaaactgcatgattccacccatacaggatatctaaaatagactcatagaagcagagaatagaatggtggttgccaagggttgggggcatagggaaatggggagctgctgttcaataaagttttagttatgcaggatgaataagttctggagatctgctggacaacatagtgtctatagttaacaaactgtattctgcccttaaaatgttcttaagagagatctcatctcaggtgttctcactacaacaacaacaaaaacaaaacaaagagacacaaggaaactgttgaagtgaaagatatatctattaccttgattgtggccatggtttcacaggcacatgcatacatccaaactcatcaaattatgtatattaaacacacgcagtttttaatattatttagatgtcaatgcagctgtttttaaaaaaaaaaaattgaccatgagttgaagctgaattgagggtacatgagtgttcattacacattctctctattcttgtatgtttgctaatctccatagcaataagtttattctgaaactgagtcaatttaaagaaaaattgattaaataataatgtacttcaagggccagcatgcttttctgtaaagggccagatagtaaatgttttaggatttgtgagccatatggtcgccatagcaactgcttaactccgctgttgtaatacgaaagcacccatagaaagcacatctacagatgggtgcaattctgttctaataaaactttatttacaaagacaggtggcaggccatagtttatagatccgtaaagtaggtgataccttgatatggcaaaatccaggaaggtgatacaggaaagactgaaataagaacagcattcagttactgggaccctgagtctcctctctttagagaaattaataaattcttatgaattcagtcttactcagagacagctataggacacccttggtgccaggtagaaacacaaataaaaggaagacaggaacaagatgggagcacggatgcatatccactcatccatttattcaacattttttttttgagatggagtctcgctctgtcgcccagactggagtgcagtggtgcgatctcggctcactgcaacctccacctcccgggttcaagcaattctcctgcctcagcctcctgagtagctgggattacaggcgtgtgctaccacgcccgactaatttttatatttttagcagacacagggttttaccatgttggccaggctggtctcaaactcctgacctcaggtgatccgcccacctcggcctcccacagtgcatgagccaccacgcccagcccattcaacaacattttatagaatcccctaaaggtggaggtcatgtttgcatcagagggtggtacaaggggagggaggtacttagcctattcctcaccatcttcatctcccactgagatcacctcacatacaggtgcccttccactgtgcttagccagtgagggactaaagactcccccacagagtataaattgccatgtctatttcagagtgacagctattaatattattattgttatgactctgaaagcccactcatctttgagtctctggcaagaggtgaaagacaggtgttgggaggtggctcctggagcgtctgtagacagcatttgcctaaataatggaatccacgtgtaataatcatgcttgagataaagagcttccccatccctcatgtccacttgcttttggagaaactacataagcaacattcccaagcagatgaggaggcatgaagcaagagaccttgatagtccagaagccgcatgagaaacgtcagctaaatgtagccaccctcttgctactacctacacaatcctctccagtgcaattggaaatcctgaatctcagcaaagatcaggcatgctaaactcaaccctggagacctgccttgcttttccctcaggccacccaggtaccatgtgactttcttatgagatgatcaaaacagtactttgtaaaggaacacttctattcaccaactcactcagcaaaatacttatggcaccccctgtgtatgccaggcatagtattaaagaccagggagaacaagaagagtaaatctagtcccacactctaggagcttaacgagcagcaattttgccctccccccagcaaataattgtctggcccataacgtcacgttcaaagactgagaaaccctgctaaaagaagacacagattttaaagaaatgataatgtgaaagaattaattgtagaagtgtactgtaatcccagcactttgggaggccgaggtaagcagatcatttgagctcaggagttcgagaccaggcttgggcaacatggtgaaacaccgtctctactaaaaatacaaaaaaaaaaaaaaaaaaaaaaaatagccaggcatgcaggcatggtggtacacacctgtggccccagctactcaggagcctgaggtgggaggatctcttgagcctggtagggcagagcttgcagtgagctgagattgcaccgctgctctccagcctgggtaacacagtgaggccctgtctcaaaaaaaaaaaaaaaagaagaagaagaagaagtgtatacagggtccaaccatagcaaaatcatgaggaggatcaccccaaaatacaagcatagcttctaccttaaaaacagaaatgaaaacccttatgtgacctcgtgtccctctgtagataattctccatttctctctgttcccttttatagcaaaaatgatctagagagttggctataaccaccctgcctacttctgtgctattctttcctctacgaactctggtcaggtgtggccacgacggtgctactgaaaggtatcctgcaacctctgtgttgtcaaatccacaggacaattctcattccttgtcctaccagcatcagacataatggagaattcctttcctggacttgccttcctgagcttcccactgccctggttttcttgctaccctactggttgctccctgtcagcctccttgatggtttgtcatcaccttcccaacctctcaacattgtagagcccaggaattggcaaactacagcctgtgagccaaatccagtccaccacccagtttttgtacatagagtttcattataacccagccatgcccattcattgatgcattatctagagctccttttgtgctaaaacggcagagttgagtagttgcaacagatcctatggcctgcaaagcctaaaacattttctactggccatttgtagaaaagtatgacctaagttatcagttaatcatatttccttaaactgactccattttaaatgaattttttattacgaaaattaccaaatataaaagagtggagcattctgtgaccttaaatactatctaaatgccgacagctgcacccacaacccaggctctctcctgagctccgtgttcacagatctagccaacctgtttgatatctgcttccacttgaatgtgaaatgatttgctgacatggccagagcagagctagagatatctccctcttctctgcgtcttccccatctcaacaaatgtcaactccatccagcacgttaactataccatattaaaactctaactaaaaataaagctaacatatgacccagcaatcctactgctaggcacatatccaaaagaaaggaaatcagtatatcaaagagatatctgcactcctatgtttattgcagcactattcacaatagccaaaatttggaaacaacctaagtgtctaccaacagatgaataaagaaaatgtggtatatatacacaatggagtactaatcagccataaaaagaataagatcctgtcatttggaacaacatggatagaactggaagtcatgacgttaagtggaaaaagccagacacagatagacaaacttcacatgttctcacccatctgtgggagctaaaaatgaaaacagttgaacccacagacagagagagtagtgcaatggttaccagaggctggaaagggtattgggggtgtgagggcagggaatagggatggttaatgggttcaaaaaatagaaagaacgaataagatatggtatttgaatgcacaagagagtgactgtagttaataacaacttaattgtatatttttaagtaagtaaaagagtataattggattgtttgtcacacaaaggacaaatgcttgaggtgatggatatcacatttaccctgatatgattatagcacatttgcatgcctctgtcaaaatatcccatatacctaacaaatatatacacctactatgtatgcacaataattaacaattttaaaaatttaagaaagaaatctaggactttgcccagtggggcaacctgggtgaagcatatactgaaattctctgtactaattttgcaacttttctacaactctaaaattatcctcaaattttaaagttgattaaataaaagccctaagaatcattctttctctctcattcttttctttctgttactccgcacatcaaatccatcagcaagtacagagcagtccactttccaagcacatccccaaactggtcagtttcaccacctccaccagtacctcctcacccaagtaaccatcctgtcctgtctccacctggattattgtaatatcctcctaactggcctccctggtgccccctatcccctcctcactccagaactcctactatccatgcagcatccagagtagtattttttaaagacataaataaagttaggtcaatcctttgttcagacccctccagtggttttccatcacagttgaaataaaacccaaactgctcttttaaaaagtttaattgtgtttaattgaacaaagaatgattcaagaattgtacagatctcgaaccagaacaggtgtgaagaggctccatttctaccacaaagaaaatttatggacagagaaggaaagtggcagacagaaaatggaagcgaggtgcagaaacagctggatccattacagcttggcatttgccctacttgagcccagtttgaacagttggtcccccttgattggctgaaactcggttgtttggacaacagtgggttacagtctgtttacacatccagttaggttgcagttcactacttatggagaaacctttaaagtatgtaaagaggcagcttttcgctaaacttaataattcccccttttgatcaacctctcagttgagagactgaccaaaactttaggcactggcatcactctgtcactatttggtttcaaatcccactaggaaatagcagtgggttttataaggtgggaacaagggcttcaggttattttttataagggttagagtagaaggaaccttcttgacctggtatctcctgttttcaggagaaaaacaaaaccaggtctattttaagatctatttgtttttaaagtcttttcatggccaagtcccatgagagctgccctctctctacctctcagaacctgtttcctcccacttcctatctgatcactctcctgcagccatcctagtcttcttactattccccagacatggcaagcccaccctcccctacccacccagcgtctagacacttgcagtcacctgctgcctatactccacacggctcacttcctcacctcctcagagagacctttcctgctcagcctctcttaaatactccacctttatccatccacagcactctctgtcttacctctccctgctttatttccctgtctagtacttaacactacctaaaattaacttatatgcttcttcattctgtttatcatcttgcttctctgaaaggtaaacttcctgatggtagagatcatgtccatcttgtttatggctgcaacctgtgccctgaacatgcctgacacatggtagatactaatatatctgttgaatatcatgcatgttgaatgaccctacccagaagaagtcaaagaaagtttcccgaggagatgactgttgagctggggactaaacaatgatgaaacaggcatgtgttaatttctttggctgcatagcaaccactactgccatcaatgccctcggggaatgctcactcttcctgtccgccatcttgatgagtctattaaatgcacttgcttgatcgagagctgagatgcaacatgcaagctgtgtccaacaggctttttaattttgagtagcatgccctcagagtcctgcctagtcccctcaacctctcaagtttgtgagttccccctcttttccttttcaactttagctagccagagaatgtgtctggtgcttacaagtgaagaactgtttctgacattgccagttaggtggggaggtgcattctagacagaggtaacaacttgcaccaaggcattgaagcatgaagcgatgggaaacaatggggcatgaaaatcaaatgttccttcaaggtgcaaacatattaccctaaaactccatggttccctagggactcaattcaaaagttacagggccatttttaggacatctctttgctataggaaaacaggacattttctgcaagatcaatgcttgaccaacatcagattcaatttttgcatccttcaaatcatatcaggctggaaaattaaaagtttcctctcatttttatcataattactataacaaccactaccatcttgtgtttgtccagtaatttcagcttttcaaagaaatttcaaatccattaacttagtctctaccaaggcctccgagttcgaggcattaaaggctccccaagtggaattaccaacgtgttataaacgaaagaatctgagtcaccaaaacagcccagcctctgtctgacctccgaccctcctcatctgacactacagcttttcccaaggcagctgcaggtgagatattcattcaaaccagcaggaagagaaatgctgaatctgcacaatcagaaccttctgctgacttagcaccatgtctacagagatgctgctcttgtccttcgtcctgagaaggagacacagtgtgcctgaaggagcccatctcagacaccctgcccctggcagcagccaccagggaagccagtacaatagtggtctcagtaagggaggacctaggactgcgcaaaaaaatcaagcagtgtaacccaaaaatccagataccagacagatccaagaatgtggctagtgccatttccatttgctcaaaattagcatcaaagttaggaagagtcagggttaaaatacaaacaccccatgctccaaccaaagcgatctgcatatggctgtccatacgcaccatgtacttggccacctacgtgtctttattcatgctgttttctccggctggagaagctcatggaaatggtttatttttgccaaagttagcatttaacgtggacataatgatggttcaactccatggatcccatgtgccaatcttcccccagctccactattgaaattctatacatccactgagtccagtccgttttccccccaaccatcactcactctgacctggttcattctccaggagcctcagctgatttttctctagcttgatcacccttcttggtttcatgttcagttcaccattgcctttaatgataaacccactcttccgctagttaaatccatgtcaccttcttgacaagcaatagtgctgaggtcagaactctccccatagccataccctaaaagatggtacatccagacaatagaatattattcaacgcaaaaaggaagtgtgacatcaagccgtgaaaagacattgagggaccttaaatgcatatttctaagtgaaagaagccaatctgaaaaggttacatactgtatgattccaactatatgacattctggaaaaggcaaaactatggagacagtgaaaagatcagtggttgccaggaggtaggggcttagggaagaataaataggtagaacatagatgattttttttcatgaaattactctgtatgtcactatagtggtggatacaagtcattatgcatttgttcaaacccatagaatgtacaacaccaagggtgaattttaatgtatactatggactttaggcgataattttgtgtccatgtaggcctatcagttgtaacaattaatattgttacaagttggtactattctggtggggtatgtggatcacagggatggctattcatgtgtagggcagggggtatttgggatatctctgtacattctgttcaattttgctgtgaacctaagactgctcttaaaaataaagtctgaaaaatgctgcatagctttccctccctctgccaaccagtccacaagtactggatatattggccatccatcacttgccaggcagtatctaggtgctggggggactctacgaaggggatatgctcctgcccaggtggagtttagcagggaatctggacagtgatgaagtcatttcaaatatgataaacccatcaggtatacacaaggagaaaagctaattttcatttttataggtattttataaacatttttctaaacactctactatagttagggtgattttacatatttctgccttgtttcttgtgctagaacataagatcctggccttgagtcagaggacaagtcaaaataaattttgtagccagagctaagttcagtatactgactctaagtcctataattgagactccaataccaaacaatctttgtttgggctggttagaattttccactcttacaaatgaacactcacctcatctagacctgccacttggacaactgagacggaaagatctccttaatgcagcatgtcctggaattcaagatattcattcaacaaacactgcctggtcacctacttcatgtcaaaccccgtgctgaatgctggaggggcatcggggtcttcgcaagtgctgtttcctccaccctcctcccacgtattcacaaggctcccctcctttctgcattaaggtctctgtgcaaaagtcctcatgtcagagagggttcctgtgcattcattaatgctgtccaccccacagtccagttttcctctcgttccaggcacatggcaggagagccctttcctggccccttgaatcagttgtggcaatcaaatgtgagctgaagcccttaagagccagcgtatgactcaccacatccccctccccacctacaccacaacaaccagccatgctccatctgggcccacaagtgaggcgatatggcgcagaagtcgtagccaaccctcggtgggcacgttgcatgaacgagaaataagcctttattgttataagccattaagatacaggggctgtttgtgcagcagggcctcatccatcctagctgatccagctttcctgaaaccctatcttaaagggcatctcctgtcactttcagtctctttaccctgctttgcctgtggcacttaatgcaatctaacattatatatttaccgtgtttatattttgtccccatcccctggaatataagtttgataagggcagggacattgttcccccagcatcctcagtgccctgaactgtgtgcctgggtagaggaggctcagtacatgtttatggaatgactcactgaacacattaacacataagacactgttcctgtcctcactgaggacagctgggaagctaaatcaacaaataaattatcagaatgcaggagctacaaaagtataggaacggcacctaatcctgtgggggacagcagtccaaggtttctcagagggcatggcttctgagatgagttttgaaggatatgagacagacagaaatagcagcacagacaagtgccagaaaatgtgaaagaggcacatttagagcaatgtgggtttttgttatattttagcaatcagggcaatggtttttgtcatattttatcaagccaacaagaacaagtgttgtataaaaaacagaaggggagtcttctgatcaaatagatttgggaaacattcgttcaaacagcaggaaataagtttaaaccgtgtctgtagcgcaggacttctcagagctttgaagaggctcatgtgcattgtaaatatctgaggatcccatgatgtacagcatctcttaaatttattttggcttaaacttttttctgtagggtcatattcctcagagccctctttgggaaagtctagagcaaactgcaaaatgaggagagaactgagttgaagctcaaaaggtcagcaggggtcagaaatcagggatttgtgcagccaggagtttacattttatctgaaggcaatgcagtgcacatggtgagtttgcaggaagaagttttattaccatcccccatcacagaaaatgaatatccttgttggtcttttcatcagcaccagtaatcaacatctgatgggccaggagacccatgggactggtactcaggaagcagtgtgtccctcagcaagtccctgagcctctctgagcctcatatttcacatctgtatgatggttcaagttaaatagtggacatcccttctacagtccctgccaattctcctggcagataatgtgactgcaataccatccatgattataatgtttggtataacgatttaatgtactatcttttccactgaaagagctctgtattagtctgttctcacactgataataaagacatatcggagactggtaacttataagggaaagaggtttaatggactcacagttccacatggctggggaggcctcacaatcatggcagaaggcaaatgagaagcaaggtcacatcttacatggcaagagagcatgtgcaggggaactcccatttataaaaccatcagatcttgtgagacttattcactatcacgaaaacagcacgggaaagacctgcccccatgattcaattacctcccactgaatccctcccaggacacatgaggattatggaagctacaattcaaggtgagatttaggtggggacacagccaaaccatatcaagttcaaaggctcaaaggacttcaaaagaaggggcaagaataaataatcgcacagaaatccactttaagtggtaggagggaccctggacgatgaaaagggtgatctagcccagggtccaggaaaactgtcaggcttcctgcccatctgcccactctgcacctgcacgcatacctgacttctttctccctagaagagctcctgtcccccacagtgattttcaactctcttgctatgcatgaggtcagccatttcatggctccacccaaatcttctgatgcaaaagtggaatggactcatgccataatgctgggctgcctgatcatcgcatgtggtcagctgtgtagcagaatataaattttaaaaacccaaacgattaaactgtcacttcctattagacaaagcacattccaagatgcaactaatgagggaagagaaataaggaaagaaagtatgtttgacagaggcagtgtggctatagctttctccacttctgattgacgacaagatggtttctcctgcaagtaggcacagatttgctctttcaacccacgtatactgggcactgaggggaggaagatgaaaatggctacagcaagggtatagaagaggaataaattcacagtcatgtggggaggccattctgtctgtcttctggcataaaaaaagactgagtgcataggaggcagaaggcgattgcttcaagcctaagaaatggaaaaggcaccttggagaacttgacacttaaaacttaaaggacttaaaggcaaagcgggactaacaatgacatgtttcacacttgtatttcttcttacagttttcagggttttcatacaccttatttcattcgatcctaataagaaccctgagaggtagatttcaactgtgctttccaaaagtaaagatggaggtgggaggaagaactcagcgatggagctagaactatgggcacgtgaaagaaagaacaagttatctaattcacctgatgggtgcactgtgggagacagagcctggtggtgatggggggcagactgaggtgattcttggatgcctggctaagggtttagaatttaccctgaatataatgttgatatcaccaaagctttaagagtggagagtaacatgtccaatgcgccccttgagtaggagagcttcccgtataagcaggaaactcagaagactggaatcaaagctcaggtggaaggtgataaggaccaggtgccagggatggagacgaaccaagagttgggcagtggaagaatggaaaacaccagagggccaggtatagtgtcagagattgttttatgtcttacttagatgagacacaaaataatattaaaagtatgcaggataaaactctgattatctttcaatccttctaattagtcagtgaggaagtctcatcttggtgctaataggtcttcaacacctttctaacacttgctaattatttaaaggagacaataatatactgtattagtccattctcacactgctataaaaatactaccagagacgggtaatttatagaggaagaggtttaattgactcacagttctgcatggctggggaggcctcagaaaacttacaatcatggcagaagatgaaggggaagcaaataccttcttcacggggagacaggaaagagtgtgagcatgcaggaaagactaccatctataaaactatcagatctcatgagaattcactcactcactatcatgagaacagcatgggggaaacagcccccacgatcaatcacttcccttcttcaacacttggggattgcaattcgagatgagatttggatgaggacacagagccaaaccatatcatatgctaagtgagacttggcaggaacagtagtttgttatattttaatattactactgtaatctttatttttggtttttttactagtggcaagattttgtttgtttatttgattgttagtttgctgttatcttctgcttatcataagtgaaactggttttcattattggcagtgatataccattctcttttaaactatatttatttttatttatttatttatttattttttgagacaggatctcactctgtcaccaaggctggagtacagtggcccaatcacagcccactgcagcctcaacctcctgggctcaggtgatcctactacttcagcctctcgagcagctgggaccacaggcatgtgccaacacacccggctaattttcatattttttgtagagacaggattccaccatattgccgaggctagtcccagactcctgggctcaagagatccacccgtctcagcctcccaaagtgctaggattacaggcgtgagccactgtatctggcatcattttattttaagatgtaaagaaaagtattctggtggtgggagtagggggatatctatcctcaataagtcaagcatagtattaccatgtgacccagcagtttcactcttgggtataaatccaaaagaattgaaaacaggtgttcaaacaaaaacttgtacataaatgtttatagcagcaccattcacaatagctaacagatggaaacagcacaaatgcccatcaatggttgaatagataaattaaatatagtatatccatacaatggaatattattcagccatgaaaaggaataaagtactgattcatgctacgacatggatggaccttgaaaacattatgctaagtgaaagatgccagatgcaaaaggtcacataacagacgatcccatcccatctagaacgagtaaatccacagatacagaaagcagattaaaggtttccaggagctggaggggtggggaaatagatcgtaactgcttgatggttactggtctccttttggagtgatgatgttctggacctagatggaggtgctggtcacacaacattgtgaacgtactaaacgccactgaattgttcactttaaaatgtttagaatggcagattctatgttatgtgtattatatcacaataaaaaattagtcaaagtggccaaaatgttgtgaaggtgccatggaaggaaacaaaacttaagaaattcttctgatcaaaaaaacagaggttgtggagtcaggagacctgagttcagggcccagctctgttacctgcctaccagcagtgtcaccaaaaataagcttctgtgattccctgggcttcactttcctcctctctacaatgagggtggtggtcctcggatccctgcctgcaacactctgcctgcacatcagggagctcaatatacatccgtccctcatgttccttccaagcaaggaaggcttggacaacaggaataccattgacagagagaagaaatccagaataagcatgaatcaaagaggacaggcctgggcaggttcagtatgaggcacccatggccatgtcaaggagagaagcccaccaagcacctaggggaacaggtcaggaacccagggcaagaggttgaggctacaactgtagattgtggaggcatctgcaaagctccaactactaaggactatatctagagaagaggagctgatgggatgcttggagggctctcgcctgtacagaggtgtaggtcccccaagcatgcaaaaggcagatcatcatcaatgaggctggagtgactcctgacttccaacaagcagcggagtctgtcaaggagtggaccttagcccaatcccattttacagatgaggaaaggtaaggtccagaagggagagaggaaggaagaagatacactataaaggtattattttagatagataatatatattattttatagatagctaaatgatacacaaatatattattctttgtgagagagaatatgaaagctcaaattccatcccagatcgcctaactcaaagctccacatttttgcaatacaaactatcgttctcattatgtggaacccacccaaagaaggccagatattaaagctgtaagagcatttagcccaactttcttacttgcaggagaaactgaatttcagagtttgccgcaagtcaaggaatgcagttctggaagctagtaaaggaaaggaaacagactcttccccagagtctccagagggagcacagctttgctgacaccttcattttggtgcagggaacctgatttcagacttctgccctccagggctgtaagagggtaaaagtgcgtttccttcagccaccatgtttgtgatgataatttattacagcagctgtagtaaactaatacaatcctggacctagccccttctcctaactcactattttgtttgaacatctactaagtacctactctccctcaaaacaatgttctgagtgctggaagtatagaatgatgaagtcatcaatacaagcgggatatggtctccccaaaccaagagaacaggagcacacagcacaagtgggcgtggaccaagggcatgtgaactgtggatgggttgtagacttgagcaagttcgtttctagcttctaaattccaccccagcaagtaccccagacctggctttaggaaccacgatatggcagcatgaagtggggacctcatgacaacacattctaagtaggattttggtaacaagaaggatcaaagccccatctgcatctctcatgtcatctctgcattgttgatgattcatctttttcatacaactgcttggagggcatcagagactttcccacattcagcggagccagagattttggctgttttaatgaattcttctaaccggttgcaccgccccaaattgaccgtaaaagttaacagatttgtttaagaaacaaaacttgatctcaatatattgtggacaaatgctcaatcgaacagaaagctcactgttaatttgctcttcctccttctgtattctccagctatcctgaatttcttgtctcttctcccctccaggcacaaaaatgataaggaaactttgcttgggaagaatttcgcagaggcacgttcgtggagccaggttttggggtttcgggtttcaaagtgcataccaccccagggttctcaaacagaggcacacacagcccagcagaacacacgtgcagagcacaaatacagtagaacttcctagagcattgcttttacttgtgatatggtttggctgtgtccccacataaatctcatcttgaattgtagttcccatcatcctcacgtgttgtgggagggacctggtgggaggtaatttaatcatgagaatggttacccccatgctgttctcatgatagtgagtgagttctcacaagatctgatggtcttattaggggcttttcccccttttgctcacacttctccttgctgctgccatatgaagaagtacatgttggcttccccttctgccatgattgtaaatttccggaggcctcccagccacactgaactgtgagtcaattaaacctttttcctttataaattacccagtcttgggtacgtcttcattagcagtgtgagaacgaactaatacaacttaactatttgatgaagggaaaaatggacacacttatcttttaagtcattttaaattatttcgccttagtaccaacatagttacattatgaggtaggaaccaaaatctgcatgaatttttaagatcaaattcagagaaaaggccacaaagggcacagcctgatgtgcagagcgtgtgtttatcagacgctgtccctgtattggcttcctattgctgttctaacaaattaccaccaatttagtggctctaagcagcacagattctttctcttatggctccagaggtccaaagtctgaagtgggtcaagcagctggcagggtggcattccttccagaggccctagaggaggacctatctccttgccttctccagcttctggaggatgctggcattccttggattacagccccttcctccatcttcaaagtgcatcactccaatctctgcttctgttgccacatctgcttctctgactctcacctccctgcctccctttcataaggaatgattataaattggactcacctaggctaatccagaacagtctctccatttcaagatccttaatttaattatatttgcaaagtccctttagccatataaggttagtattcacaggttccaggaattagaatgtggatgtctttgggtggggaagagggggtggtggggacatgattctgcctaccacaccccctaggactatttgagtaaaaattcctgagaagcattgaacctagaagtcctagaagggttttaggaaggattctaagacagggactcagttcctcaaagcaggagcctagtgtccagaaagggagcccacatgagaagaacaaagtcagtgttagagcaggtggaggtctgggttctgagctgaggtgtcttgactccactgaggctcagttacagaagaggagtgaggagaagccttggaattaagctctaactacctcccaacctctctgtattcattttcccaggctgctgtaacaaaggatcacagtctttattacagcaaagatggtttaaacaacagaaatgtaatttgttcacagttctcaaagctagaagtctaagacaagggagctgcaggattgctcctctgaaaactgtctccttggcatacagatggccatcctctccctgtgtcttcacatggtcctccctttgtgtgtttatgttgtgtcttaatttcctgttcttataaggacaccagtcatgttgggttaaggcttacctatatgccctcattttaccataattactcttaaagactccagctccaaagtgtcacattcagagatactaggggttaggacccaatatatgacttttagggagatacaattcagtgcattctcaacaataaacaacatatcagagggttctcctaccctcggatgaaaccagagacgtgcttctttctcctgaagcccatttgaaaacctccatgaaccaggacagggatggaggatttcctatttcggaggagggaaggaagccacagactctacaagtaaactaagcacatgatcccacgaaggcacatccaaggctctcttttgaaagttgatctttaacaaagttaatttaggctgtggagtattttttggtgagttaaaagattatttttatgcttctgcaaatgagcacatcacaccccaaaaccagagactaaaacagccctcttcattcaaccccaatgaaaacaggaattgtttgggaatctcttgccctagaagacagggaacatgggagtggggagtgggcggtggcatggacagctggcttcagctcctgtgcttttcatgggagaaaggcaggcttatgatagacagctagaaaattaacccacaagagacaagccaaagcaccaggctcagaaggtggaaggttagaaggaagcacatttctgttttcatattttaggaaagagatcttcaaaatgctctcagccctacctccctttttcagggcatggttaatatatggcagaggagacagccatcctgtgtccttttctaaacagttccctgagaaaacttctgcatacacgttggcataaatgacacgtgagatctcgctgatatcctggctggtgtgcactggtgcagcagaactggttatttaaaggctgaaatgcttccgttttgcttgtgaatagccacatcttccaggaaccccaagtgccccctgccactcagcccctcccttgggaaccccctacctccccataaccagccactaaaggattaacacctcacataacaggtgctccagaattctacaaagtgagtgtctattctgattcagctgtgataatgctgtagtggttaaatattttgagtattcctcacagctgttaatatcaaacataaatctctcccacttttgtttaaaactcattttactgccccctgccacctgggcaatatccctttcctatcacaaggcagttcttgttacaaccttgtggggattcaatcagactggtgggaaaaattttggttatagagaatagccacaaaccttcttggaaggcctgaaggtttttgcaaaagtctgagaataagtttatggcttaaggcaacctaatccttaccttaagtaaatagcttgaagtgggtacaaaggaaggcagagcagtttatctaactagcttgtttactcacgtggtcttaagaccaatatttgatcattcttgagtgcatgatggctctctccggggtaggggcaaccaggttaattacccaccaatgtgtttactcacaacctttgtcaattaatatttactgaataaatgtgagtctcactggcaagtcgaggccgtggccactgactctgtacagaaccttccttggtgtctgtaagtggcacggacactcagctagactggcaaagcagaatatctgtgcgtcagggaactttattcatctgtcattgggtcagggtctgcgggacggaccccgcaaaacctcaccctgcctctgcttttttagagaaaggaacaaacaagggcttcccatccctaccgttccccacaaagcctgggacacgaacatgactccagcccaattggacgtgagtctctacctagactcctggcaaatcataacagtggggtcccacagaatgattttctgctgagaaattttacatattaaagcaatgattgaaacaacactgatacagagacaatgggtgagcaatgcctggtgatgaagaatgaataatcatagaactccccgccaggcttcaaaatatttattattttttagaaattcaaattactccactgtatgttatattggaagccatcattgtctgaggttttccatttacacaatgagaaatatcaaagcagttaaaatatgcaatacctagggaatataaaagcgatgcttaaattaaaatatattccatggcaggtgtcttaaaagagatgcaaattataacaatgagttaatatttttgtctagccaatcagaaaaatttctgtttcaagagccagccagagttaagtgacagagatactttaagacatagttattagaagtgtccagtgattcaatctttctgggaacaaattaacggaaccttaattggttctgtattgatagttttaaaattctttaatttcagtaatggattctattaaaagccaataatctgtgatgtagacatttcattacaaagatgttaaacaaggtattggttttcatggcaaaaaattggggaaaatctaaattatcaagtaaatcatgagatatccacagaatagaaaacatagaagataaaaatgtttacaagtaatctgaaagcctcatgataaaatgttaagcaaattaaaagctatctataaaattatatagtgtgtatttgtaaataaggtataggaaaacagactagagggaaataaaccaaaatgttaatagcagttgtctgtggatgctgagagtaaaggtgatttttattttctttatactgccctgattctcacaaaatcctctaaaatacatatgtatagattacttgtatattagctgtgatttttttcaacagttcttaaagttcttatatttttgatatatatatacatatatatatatatatgtatatatatatactgacatatttactgatgaacacaatgatgtcttggatttgctttaaaatgatccagcagtgggtccatgataaaaatatttctttcaatgctgctaaacaggagagagacagagacagagagagagagaagaggagaggggaggggaggggaggggagaaaggaggggaggggagaaaggaggggaggggagaaaggaggggaggggagaaaggaggggaggggagaggagaagagaagagaggagtggagaagggaggggagggaagagaaaaagaagagaggagaagagaagaggaaaaactagtatcaattaaccaaggcaaaaccaatagcaaatttgtttttaactaaagtgcaaatttgaccatgaaggtcttcacccaaggcctgccattttcaaaatcccattcatggaagccatgcacacaccctaacaccagaactacagcaagcctgcctttttccacagctccacagcttcttcacatcgttctgagtctactcacccaagtcagttaatactacatttcctcagtcctacagatatcttagcattaaaacaattcgccaggaaaatatgtctttttctttcacccctaggacagcagactagcaagacgatatggatttcaaatgccactcactcttcctgggcaggtattcctaatttgaagagacaagatagagcaggagacattcagccatttgtgacaacaaaacggaaatctgcaaaaagctcaatgtttgatggtaagaaatgccatccagaggagaatttggaagctttcaagaccactcaagactggcagccttgaggaacaggttaagaggagaggaaggcttagattgtgaactcaattctgctcctccatgagccagccttccctctacagctcatcttcagctgtgggggatgacaacctgtaggggcaggcacccaggacacaagcctcttccagaccagctctccaatttgaccccagatccctaccctcagacctgtggatgaagctgtccctcctctgcattcccatggtcccgtgaatacaatcatactgcacttgcattatgagtctctccagctagattctgaaacaaattgataacagatgcatccacaaagcattttggtccaaggacaaagccaagaaatgtatgaagaatgaacatacatttgacctgtgaacaacacactgcatgcgtctacctatacgcaaatttcttctccctctgccaacccctgaggcagcaagaccaacccctcctcttcctcctcctcctcagcctcctcaatgtaaagacaaggatgaagacctttatgatgacccacatccacttgaatagcaaacatattttcttccttacgattttccttatgatcttcttttctatggcttacttaagaatctactatataatacatatagcatagaaaatttgtattaattgactgtctatgttattggtaaggcttctgatcaacagtgggctatagtttatgggaatcaaaagttatacatggattttaaactgcatgggggttaatgcaactagcgcctgcattattcaaggatcaactgtgtttaataaaccaataaataaatcaaatccaaggaagtctatgaaagggtttcagagggtctgtgatcccctgaaattgcacataattttgactgcatgtttatgaacacgcactcctctggaagggtccgtagccttcattagattttaaagtggtccccaactccccccaaaatcaccccaaattatcttaaattctttgagtgagtttgtgagccaagcttcaaggtgtcagtgatttttggaaatcacaacttacattttagagtgagtttatttttgttttggcaaaagagtcactgttagggaccaatggaaacaattaacctttttcaagtcagggattgtagttttcaagtcagggattgtagtttaagagaagatcctttccatatgccgacttcagcaaaaaaaaatcacaaacagaaagaaatttccattccaattaatattttccctcctgaaatgggtaacatagccacctccatggaagggaacctgagttcgaagatctacgatgcattaatggagcaaatattctttctctgaatgctctattgtattatttaggttttttcgctctgtacatcaacatctatttcaaagtttaaaaaatggagacaatatatcaattgccatcccatggaaagttccaaaatttgaacagaaagtgaaagcatttggaaagcaatttcaggttcgtttttctttggggggatgtgggggaataggagaagtggataaacaacagaatagtatctagagtattttctgccataagcagatgttccaaatgcaggagaatacaactgactaaaaagaataatttgtcaactgaaaaaccagagaggagtctggctggctctttagaatacaaacatattactacagtaagatgtgcaaaacaagctgaatatactttattaagtaataatgattaacctgatacaagtgcaaaaacaccccatttcgagatcattggcaattattctaaacattgtcttctgtagatgagcttcttagccaaaaacattttcactagtaaatatgaggccggctgacctacttatgtttttatttatatatgtgtgtgtgagttgatatatacataggttgtctgcttttcaaatatcttctaccttcaggataatgtaaagtcttttgggaacttgaggtgatgatgcagggattataaattcctcctccatgccaggcaaatttatactgaattactcacacacttggaaaaagtgaggatgttggttttcagccaaatgcttggcctaaagcaccaaggcttggagatctttttttaaaaatcaaggatttgagaggtacagagtgtttgaataagaaagagcctcagaggtgacccaacccaaccttgcaagcccaattttccacctcattcctgagggacagacagtcactgttagctcaatcatatcctgatatagccttcctattccatgaatcctcacagtcttctgttagagacctaattgccgaagcttattcctcatatcaagatgaaactttactccttatagtttcactcttggccaggtgccgtggctaacgcctgtagtccagcactttaggaggccaaagcgggtggatcacctgaggtcaggagttcaagaccagcctggccaacatggtaaaaccccatctctactaaaaatacaaagttagctgatggtggtggcaggtgcctgtaatcccagctactcaggaggctgaggcaggagcatcacttgaacccaggcggcagaggttgcagtaaaccaagatcgtgccattgaactccagcctgggcgacaagagcaaaactctgtctcaaataataacaataataataataataataataataataataataataataataatttcactcttatgtctgtccccagaacaataacaaaattaagacttaaccttctaccttgtaacagcccatggagtatctgaacacttctcccatatcccctctgagatttcccttctccaggctaaacatccctaaatacttcttctgaaactcttaatatatttcatttagagtctacgcaatcctaaaggccctttttctgcatgcattgcaatttttcaacgtccatctttagatatcactcctcggaactaagtgcaatgctacatataatggtgttagtgttgctggagacatcaccagttgtaccactgaagcatcaccccacacccttgctaacagaagcaattttgctcagtggcaattacccattctcagagaggaatcctggatctctatcattgttgtttgagcagtgggaatgtgacccagttctggccactgacatgtaagaggaagtctactccaatgaaaggatagaggccctagaagaaggcttatttttctctccctttttttccagttttgaatgctaggaggtgaaggtgtgatggctggaacagaagcagccatattgtgactcagataaaccagcagctgaggaaggcaaagtagaagaatgggaaggatctgagtcctcaatgtgacattaagtcactaagctagatctgaggctccttactaagcaaaaaactgaatgtctttaatggtttaagacactgttggtcaaagactctgttacttgcacctgaaagcactccaaacaacagaagaggtataatggagctatcacctcccttgatttaaacattatatttctataaatgtggcctccactttttataaggccacaacgtatgtggcctccacatatatttctagatatgtggcctccacatatccccacttaggatctgctgagcttctggtcaatacaaaataaacaaacaaacaaataaaaagtctgtatttgagcaccatgatctcaaatactcacagaaaccatatcattaacataaatgtatgaatcaccctagatatgggataacagagtggggacagctgtagtgaatttgaaaatgcatgctgtctaaagacattaaaattcaagcatttaaaaatgctgtactggtgaaacaaaatgcatctatgagccagattcagcgtgcagtacaccggttcatgacccttgcaaaaaccattcccaagtgagttggatgtgatagttggaacagaggcagccacattatgactaagtgagttgcaaagtctcacatccccctttctgcaatagtgaaaattcttcttcaaactattgagagaggttggtcaaaaggcaccaacttccacttgtaaggtaaataggttctagagacctaatgtatagcatggtgactggtgatagcatggtgacaatacaaaaatatattgtatacaggcaatttgctaagataccacatcttaagtaatctcatcacacaataaatgtaaccatgtgaggtaatggatatgttaattagtttgatggtgacaatcatctcacatttacttgtatatcagaatatcatttggggctggggacggtggcttatgcctgtaataccagcactttgggaggccaagggaagaggattgcttgagtccaggagttcaagaccagcctgggcaacatggtgagacccccgtctctaccaaaaatttaaaaattagccggatatcatggcacacgcctgtgttcctagctacttgggaggctgagatgagaggatcacctaagcccaggaggttgaggctgcagtgaactatgatcatgccactgcactccagcctgggcaacagagtgaaacactgttttctttaaaaaaaaaaaaaaaaaaattgtgttgtacacctttaatatatacaatttttctttgtcagttaacctcattaaagctgagtgcggtatggggggaacctccagtgcagtctttagagtgactccatcacttcaatctgaagttttgaattttaattccatcatccaacatcttaatccttttagtcaagacaaccaaaatatgaacatcaaaatctgttatttgtcttgcatctgagccccttccctaaatcaaatgtattcgtagtcattaacttgaaagggtaataaaataagagcaaaagaataagaacccaaagccctaggttctagttacagctttgaacaatgcacaaattactgcaactcccagatcctttatttcctcatctgaaaatagagattctttaaacaaataccgttggagctgccaggtttcccaggctatcactgagttattaatccttggcagagataaaatgagaaactatatatgtccacactctaaatccctaagcctcgtgcaaacatatggtccagttggtggagtcatttagtgcaaaggtcaatgagatagtcttctcctgcgatcactttcatgctggccacatttagcttccgtttgccaggataaagctctcagcaagtcctacaaaggcaaaggaagcttctgattgtctcagttaagaaaatacaaatcatttcatgttagaccctccacttctgacagttctgtgggattcactcccagtttctttcagagcataccctcatgtaaccacatcatccttaatcactctttctggttattaaaaagtacatgtacactggagaaaaataaaaactaaaaaatgcagacacaataacaatagcattcctgtaataagcatttattataaggtaggcactgagacatggactaatatccatgatgtcatttaaatctcacaactctacaaagtggatgctattattgttcccattttagagatgaagacattgaggctcaagatattaagaacttccccatgatcacccagccagtaagaggtggaatccctgaatttaaattcaggcaatctaactcaaagtacaatatattaaccacttgataatgacattctttaaaagattaaagcagccatgagtctaccaccccaaagataactgctattcatattttggtatgtttgttgccagtctttccttgatgaggcacaaaattttcagagctggaagagatcttagtgataattttgtcccaaatcctcattttgcaggagaaccagaggttcagacaggtgaagggccttttctaaggtcacacaggtatttttgaaaattgaatttcattcttcagactctttgtccaaggttttcttggatcttccaactcaagttgattcatcatggctgcctggagtactgtgttgagaaggccttaaggccagtgggctcaacagggccaggtgttataggagattaatgatggcagcagtgaacatggcatccatggttgcatacatgccatagatctgccgtcttatccaggagcagcccctggaagagctacttccctcacctacatcataggcctcacagccaagtgccttcaggatactgtgtatgtaacataaatgagtgaagtgaagtgaagtgaagtgactttggggaatttaagaaaggaggggcacctgtcctgtcccaggatggcagtgggagggcagggatcgtggcaggtggggttgggggatgagattcatctccagccaactgttgccatagggggaatcggggccagtatggccaggccttctgactgtttcaaagcagcatgaagtttggattttcttttcaatgggatgtcttccaactttaaaatgttggcaaagaattagaagttgaaagatcaaggatgggggatgcaggacaaacaaaagacaccaattaataaccttataatgtctcatttatgtgatgacttatcagaggctaccaactctctattacaaaccagagattcagttcctgtttctcttctgcacagccctctttctctctctttccccactcactctgcctacagtagcattttccatctgaggctatgagaaagaagataaacaccgctgcaaacccaccagaccacagctcttcagggcccaaacgattgtcagcaacccctgagggctacttggagtgtgagtcacgctaccgggaggacgcctgttggtctctgatgacttaagtgaggaggtgttgatgatcgcatctgacatgcctcatggaaaagactaaagataggtctccccactctcccaggaactacctgatgcctctttagcaggagctgagtgggctccaccaacattccgatctgtgcgtctgcccttttcgagagctctcagtgtttaatgggaaggcccatcactcgcatccaaactctggagctgccaggttacaagagcaccaacttccacctcctgctgatgagctgttactcagcagttctctacaggcctttcgtatgtaaccccccaatttatgctaatcctcaggatggctggtaattatctgcccactagagagaagagaaaaattggcaaacacctatgaaatcagtcagcattgagggaacaaacactgcacgaatgccctgaaccatattgtgatatgttcatccggaagctccaacaagctggcatcggagccaatgactagattcattcaatcaacaaacatttaccgtgtaacaaacgcaaagggcaggacaagtgtgaggtactgaaaaggatgcccctatggagcacaaatgaatattattaatggtggaaaaagagagaaattgttaaaataattgtggtatgaactgaacactctgcagccattgaaaatcaagtttaagaagtctatgtagtgataaaggaaaattccaagaatacataatcaagtttaaaaaaatatataaaagcaggttgtgaaataaaacggggtcaaaatccgagtgaacacactcagtaaccttccttttctgctcctaagacatagaatttttaaagaaacctttagttatttttaaatttacatagtattgcttgcaaataagaaaagagaatcacagatcaaaaatagagagtaatccctaaaaataaatgaactgaaagacgggactctagggtttcaagtaggaatcaaagccacataatccatggaggataggtccaatatgagccatgagaacagaggtgtcaatgtccatccagggaaaaaggggaagaactggacctagaatcaggctgctagctgtggatggtgctggaacatctgcaccatccaccattagtcacagccaaaaagcaggaccctatctgtgtcaaggagccaaaatgaagtcacctacatgagatggactcctaagcctgtaccacaggccacgtagaatgggaagagagtacaaacctgagctgctgacatgggctctggcttaaaatacacaccctcacagatacagggcataagaaatcataaagttgccttgaaaataagttcacaaacaaaaattaaagaacatatgtgaacatccaactaactgattctacaaatgaaggacttcacaactgaagaaggaaagatgctagagcaatcagagaagaactttataatacatattttttaatctttgaagggacaggggagggagttacatgcacaaagtgagaagagtttttcattatttataacacaaaaaaacagggaggtgtaaagaggaaccaattattatcttggaaataaagtatatccttgttgaaatctataactcaacagatagtcaaaataatagaccatccatgctgtttctttctaaaataaaataatagaccagacacaaatgaaatgatgtagttaactggagtatagaattgaagaaaccttcccaaacacagcacaaacagagaactggaaaaaaaaaaaaacaagatacatggagaattgattgagaaattacacatatatatatagtacagtcatgtgctgcataaggaggtttaggtcaacaatggaccacaagtacacaatgctggtcccataagattatattctaagtttttgctgtaccttttctgtgcttagatatgtttagatacacaaatactcaccaatgtattacagttgcttacaatatttagtatagcattcatacagtagagtatgctgtagaggcttgtagcctaggagcaagagcctatagctcatagcctaggtgtgtaacagactataccacctaggtttgtgtaagtgcactctgtgatgttcacacgattaaatcacctaacgatccatttctcagaacgtgtcccaccatgaagcaacgcatgactatacatatgcatgtatattcagaaggagagaatagaaagaatgatggaaagaaagaatccaacagatagcggctgagattttctccagaattaaagaaaatcttgaatcctctaagaaagtccacagagggcaaagcacaataagaaaaaccatatatactataaaatcctgagcatgcaactaaatagataaaaggaaatacaccaaagtgtcagtaatgtttacccatggtgataggatttggagagagatttttatcttctttaaatttcaatgtatttcctaagtgctctacaatgaaaaggcattatttttatatgtctgcggaggagagaagcatttgtcatgtcaaatacacatatacagataaacagtttttttaaaaatctgccctcaaacgacttacactctggcagaagacatgaggcttgcataggaataacatagaaaacgaaacccaagtgataactggcatggatggatatagctaaaatctgagcctcgtcttttcctgcatggagcaattaggaatatggggagaagtgatggggggtgagagggttaaggacactgagcagaagtgtaaagatctagcccatattctgggcttaccagggactattactgcagctggagtgtatttcacttagacagggtcaaaatggccaagccaagataagattagaacttcatctacatcgagcattattttcacctcttatttattgattttaattttccttctttttttttttttttttttgagacaaagtctcactctgtcacccaggctagagcgcagtggcatgatgttggcttgctgcaacctccacctcccaggttcatgcaattctccctgcctcagcctcctgagtagctgggattacaggggcctgccaccacatccagctgatttttgtatttttgtagagatggggtttaagcatgttggccaggctggtcttgaactcctgacctcaggtgatccacccgccttggcctcccaaagtgctaggattacaggtgtgaaccacctcgctcagccttattttcacctctaatttagttatattgcaagactacccaatgatgcgagcaaaacattagcacctccattgtaaattaaattaacaccacaaaaatccaccacatttgcatgacatttcaattgttataaggctttgttattttcttcaatggtcaagtagacagacagaaggaaaatgtggcacatacacaccatggaatactatgcagccataaaaaaggatgagttcatgtcctttgtaggcacacggatgaagctggaaaccatcattctcagcaaactaacgcaaggacaaaaaaccaaacaccgcatgttctcactcataggtgggaattgaacaatgagaacacttggacacaggaaggggaacatcacacactggggcctgtcatggggtggggggaggggggatggatagcactaggagatatacctaatgtaaatgacgagttaatgggtgcagcacaccaacatggcacatgtatacatatgtaacaaacctgcacgttgtgcacatataccctagaacttaaagtaaaaataaaaataaaaataaaaaaagttaaaaaaatgtgtgtgtgtgtgttcattttaactgataaccaaattgactactattcttaccagcaggggcactatcatgttgccaatgtagaagtaaatataacacacgtgtgttctggatgactttaccaaatcaacatcattttaacaggaggcagaggccttgtcaatctaggaaggttgaggctgtagtcataataccatttgcaagcgaggcaaggcagagttttaaacaatgcaccgtgactgtttctttggagacaaataaactcaatgttcagctctaaatgaaacatgtggcagaagcacaagccatctatatatgttactaatggaaggaagggctgttcacctctcagacaatctcctttctaaatacatccccagtttctcaaaatacgaccttttaaaccaacttctcttggtatcacccaactcctctcaatatcaccgttccacatggggaccagacatataccccgatgttacctccactgagctctttgcttccctgccaccttgcctcatctccctacagttccaccagaatcacagagagtggccaatgtctccaagaccaactctgaaagtcccaacaacaatcaggagtatcgaatcccctcctccatttttgaaccaatggaccctttcattcttcttctctccaacccctcttaagtctctattctttatttctctggaaatgtcttttctcatcttcctcttgccctttcctgattccttttctcttcttactcttaagtgaggtcacattttggtccacatccccaaaacgcagtttcatcccaaaggagagaagaatgtttccacccatactccctggacttctcaaaactttctttctaatgcccccttcaagggaagaacagttgctggtctagttggtcacaacctgccattcactgggtcaagattcactagcaggcagggtcactgcctatcaagggggttcccttccatgaccctacactcttccggcttctctctgcctacgttcggatgaatgagtcacatgacagcctgagccacacacctatcgactgagacttagaagtaagagccaaagcctacccggaacctcccagtctcacaccaccttttccaattcagcttttcccagatttctccattgggttgtgccaaaccctcatggatccagaaatttcactttcagtatggttactgtttccagtctatcactcctttagaaaaactcaagaaggaagaagggatccgtggtaatatttaaatcccaaaatcatactccaaggcgtggctggaaactggctgttcttctccctcaatgccttctttagaagattggcccctcccatacaaaagccctctaggctgtgattcatcatagctctccatgctcagcccctcccacaaaatgaaactgatcccttgtccctcctgaagatggatgacatcattaaagtatgggcttgatttagtggaatggaagatcacaccttgggatcagaaattcagctacctagctacatcagccactatgtggtcttggcaaattcccttaactcccctatggctcagtcacttcatctgaaagttacagcatgctccaagaaaccctaagatgctctccagttctgaaattgtcagtggtggcagagcatggctagtccctactctcttcttcccagacaggagccccccaaaactgagaagtgactgggaaaatgctcagctacacacaggaattctgctagcctgcaaatcatttaaaatgaatgtttaataagacactgcatcaattgtgtgctacagctgaatgtgctgcagcccaggagacctgaaagaattaatacggttaccaaaggagctggtaggaatcgctgaaacagaagcaaaagctgatgtgatgaatataaaagtgctttgagagcatcaaaaggaaagcgctacagtgaatgtctgctcactccactagaatatctcctgccatctaaggaacactctccaagaaggtctcagggctagaggctatggcacacaagtacacttactctttcctcgccttctgaactcccaatcttttctcaggacttagaggacagtacacacacaactccaatctttcccttttttctcattcctcactttacttcttcattccagccttcttccttccctccacttctgtgtaattcccaaaccaggctgtcataacatcgccttcaaatcttcaaatctctctcccttcttctccaaaccaaagctcccaggctgtccacaaaaaagaccctccctctcattcagagccaactgatttttgtacactctttcttgcattttgagactctccaactttagtaccaagacccatctttgttcaggagccaactccttcatctgagggccttggagccccagacaaagaacacgtaaggaaaatgccaggccctccatgctctgggtttggagttaattctttccactcccacccactccccttgaggaacgggtctctcctccgctcctctggcccagggcttctcaaactccccacctctgttcctctaactgcagagtcagaggaagcatgacattttttctgcccttttgtgctttacctaaaaactttgcattttcttccagaacctacccacatttaataatttttagaaatagttttagtcacttaccataagaggaaaaaatggacattttcccacaaaacaatcaggtaaaactggcattgtgaaaataggaagcatatgtctccagtgctcctgggcccacctctgtgccccatggtactcgtaaatctccaaacatgccaccaccgccaccaccaccaccccacagcctacttctcagttttctgagcgcttcctggcacacacacaccaaagtgctcctgtgtacaccattttcagaaacaaggcaaaaggcatttccattcatttctgggttggagaggcaagacctggttctcaccagggccagtggccacgaccctcccacccccacccccacttcacatcaagacagattctaggggcgtccgaagacctgcagcagctgccatgcagctggtggcttcccaggtcctggcagggcatcagtttccggccttaccttgtcagccatgatcatagatgcgcccccatgaatgcccaagatggggacgaaggtgtgggaggagataaaatccagcatctgggctacggcctcctggtccgtgtcgtccccaaacacgaggccgtggatgcgtgccccggacatgaggtcgcacacgtgcgtgatgaggctcttggggtcggtgcggttcatcagcagagctaccacgttcacgtccaggggcagccccgccgcctgctcggggccccacagtgttcgaagttcgcgctctgtcacgtcgtggctgtgacccagcatcaccgcaatatttagcgcggggggacccttctccgccgccgcgctcggcgccggaccgcgccagaccagaagggccggcagcaccagcagggtccaatagcccactctgcccatagtcgccactgacggtccctgcaaggtgaagagtgagaggcagggccgcggtgagcaaggcgaccagaagaaagggattaccaacttggcttcctgctctaggagccaggcatggaactcagcagcaggataggctgctgggatcacggactccattccgagtccccgacgccatccacatccctcgatccatctctaactctatccacaactccaattcgagctaattctccatcccccagccccttctcgcatccagcttcctcatcccctgtctccaggcacttccccatccccatctctgtccatatcccccaccgcattccccaagttcgccgcgggccacagaccctaagcgccgcgcgtgttctgtaccccaccaagctcctaggtgcacagaataaaccctccatccaacccctcccacctgggatagagaggaccaagttatcaaccccgccccctgctggcgcggagcgaactacagaccccgcagggcgtgcggaggcggcacccagaccccgcgtcccagcttgagagctcagctagttggctgaccccgccccctacgagcccgtcgtgtgcaccacacactttgctctacgcccagccccaactacagacccggctcctctcagtcagagtacaccccaagtgcttgggagtgaggacgctgcctggtgggcccaggctccgctgtgcctggggaacttggggctcgccccacctcgagccaaggggccgtggagagtccttcacccctacacgcgcgcgtgcacacacacgtgcacacacacacgcacacacacatgttcacacacacacaccctctctcacgcgcgccgtgtgcaatgctgaattctggagagtaggcgcgtccccccgcgggccagcgcgtaggagctggcaaagaacgtgcgtagggggaaaggtaggctcccaagaagctcccagacggacgtggactgtacagcccctccctagcctttctactgcgggcgctgttgccaagtcctaggtgcacgtgggcagtgggccgcacacgctcataggcacgcgcgcttttctgcgcacttcctcagactgctgtagcggtgcccacggccagccggagtcctcacatgtcctcaggtggtgcacacgcatgaactgcggcaggtgcacagccctgcgtacctgcaaataccagcacggtcgtgcacgcgtgccctgacgcgcgcctctcgggacggacgctgctggagccgggggaagttgaggcgaactccaagaggcctcgacgttcctgggtaagcgccgcggagcgcggagccgcagcgccccctggtgcccctcctgcacttcgccgctgggctccctcccgctttccctctccctctctagcctgatccctctcccgctctccctccggtcgagtctccctcctccccggcccaaggagccctgatctccctctgggacgtacctgtagcccgagaaggtcgaggatgcagtggggcgcgctgcgcgcacgagcatctcggccgcctcagcagccaccgggtttagcgggttcccgcatgctgcggccccagcgcgctcccctggctgtcccgcgctgtccgcatcgcccccacggggggcggctatcccagccggaggctctgcagcagggctctaacggggcggaggagagaaggagaggcagggtcagcccaccaacgaggggagggagggttgaggggaaggctgcagtctgcagtgctcacaagcccccctatgcgcccaggggggctagacaagaggggggaagctgaagcccgatgcccacgacgcccccagtgcggatcctcagcccctgtggctgatagcgggagctccactccagggtgcacaggagaatgggagccccaggttggccacccacgagaagctaactgggcacctccacccgcaccccctaccacctccccagcgccggctgctgggagttgtgcgaccgggagctgctgagcg

SEQ ID NO: 787 - DNA, 295072 bp, Homo sapiens
gcgtctcgcgtctgggaacggccgggcccccagcgggctgtggtcgcggggtgggggccggagcggcgaggccccccttaccgggctgcgcgggccgcccagggcccccgggctgagacggggccggagcggcgccccggccgcccgcgcggggtctcccccatggtgcagcggggttcgggatgtcgaagacgctgaagaagaagaagcactggctcagcaaggtgcaggagtgcgccgtgtcctgggccgggcccccgggcgacttcggcgcggagatccgcggtggcgcggagcgtggcgagttcccctacctggggcggctccgcgaggagcccggcgggggcacctgctgcgtcgtctcgggcaaggcgcccagcccaggcgatgtgctgctggaggtaaacgggacgcctgtcagcgggctcaccaaccgggacaccctggctgtcatccgccacttccgcgagcccatccgtctcaagactgtgaaaccaggtacgccggccctgcgtatctgtctcggggtgttggggagaggggcttcagggtgggcgtcctgggagcggcggcacctccccaccgcgtattgtcccgggtaatcttagacctctagggtgtgccagactccttgacgagggggaggggtggcgttggtgagtcccattttgccgaagggaaaactgagctctggcttggcgcggttgctctgctagctgtgctagctgtcacagaattgcgactagaagctgggtttcctacatttgtagctccatctccccccgcagacaagagtttttgactagagaaggccagccttttcctgtgttgtgcaaaaaggcccttaggattgtaacattttctttggaacgatcttacgcatcttctaacagggaaaaagggactttactatagaggcacttggtgccaaggttaccacctggtgtacctggaagggcttagctgcttcagtgtttcttgcactctagcagacatctcagagctgacagcctaactctgtcagtccaggtggttcaggtgtctgagtaccgatgacggtacaatatgtgatatgtggcagactggtgtgttcttgcagggagctgttgaatagagtctgggttttgcaggaagacctaggtgcctagcggagtgaaagcttctgtaacgcttttgattttacagaattttgttgaagtggtaggttaaaggagcctctgttgccctggtatcttttatgctagtaaaaattgctgcaaagcacgttatgtttatggcatactcgtcagtttcaaagcattgatcagagacagcatacagtgagatctgatagtatgtagtagttcttatgaatttgttatagacagcattgttggttttgtttcagcatagatagaatgtggttctgtcgtcttagatgtttgtgggagagagaattgtgattgtaacattattagaaaccaaactgtttttccttaatgtgctctgctgagtatacggtgcatcaaaatataatgggctggttaattgttacctgggctaggtagcagtccatcccttgatggcaaaatgctagaaaattctggataaaaatttaatatgttatctccttctcatttctttctcagcagctcgctttggaaatattaatatatctttaatagtccttgagcttaatggggcttgatggtttgtggtgcagtttacatatgtctgtgtattgtggatatgtatacacacagactcacatgctcctaaggtcataattaagattttctttctatagcgtattccatcgtattcattttaagtgtatgggtttatgtggtgaggttttctttttattgttgttaattttttaaaactttggcagactttaaacagctttttctgtatagttttgagaatttgtaaatttttttcttaactctaacttttacagccatgtgtgaaaggcagaggaaagacttttggggctgtaattcagctagtcaggcactgtctgtaatatgcaaaaggctatatagacagcatttactagtctagctgccaaatcttagttcaaatcccatgagttagtgaatagtgagaacatctgcatcatttctttgtgttttgttttgattcgttagggcatagatgagaatataacttatttttagaaattttaaagttgatatattgacatggaagctggtgtattctaaattattgtgatcttttttagaagactgaagagatggctatttcataacattagtctaatctacctgttatacatttttctcaacctctatattatatttaacaataattcaagatttagagcattagtaatattaactgtgttgaataaacatcctatgcccccgtatgtagttgacattattagagtaatacagttttgccctcttgacagccacagacactgttctattttaaagatttagccaaaataaagggaataacgtattaatggccacagaacattttgtagtcattagtaataaagttctgaatactacacttgttttttgaagagacactttgtgtcagtaatttctcaagataccattatgtctgtgttatttgagattaatattgtttctaagcaggttgtaatttaaaatttttaatctcttttaaaaatagtattcttagcttcttaatagcctcatgttaggtattatattaaatggctttcttaaatggctttgcttaaaagcaacatttgttataaaatagcaagatttttgcaggttaaacagactttaaatactagaaattaagaatttgaagaggttatctgtagaacttttgagtttgattaaaaacaaatattattttcagaagagacaaagattctttattgtgattcattttggaaaggatgaaaatagagtaagggaatttaaaaagaaacttgccataaacattgttttattttttgcttttatctaaactttgtgacagaaattgatttttcaatttaataaggtattgtaaagtgtacttagcactctcttgtcttgactagttgctttttattaaaccatattcataacatgacatttagagactagcacagtgaaagagtaaaatttaaccatttttgtaagatgtaatactaatcggaaatgttctcatattgtcttctgacaaagtccatggcagaaggatgagctgggttgtagaacatggcttttgtagcactgattcttcctagccttcttttcacttaggtgctaagggtcgccctcccaaagccagtactatcagccaggtgacttaacatctttctggcagctactgtctttagctttgattttttttccctttttttgttgttataatctttaatagagaattgaaagttactctttaaaatatggtttctaatctgaagcttttcctgaatcaattaggtagtttcttattgttttagtgtagtacttagtagtcagtactttgcccgcttatagaagaatctttggtttcacctattgcttggctcgattagttacttgtttcttaattatgaccctgttgtttatttttctgcaaagagaaaagttgtcatttgagtttgaactttgtcttttcccagtagtaaagttgaactttggacctctggtgaaattgttttgtgatatactactatgactaggtttagtttctttgattttactacagagtatatattcttaaaccatttctattctgattaatatacaagtagtgaattttgttctgaaattccccagactctaattgtgcagagttttatgcttcttcatacacctttaagctcatatttcagcagtttgctttcagtaagtttcagtaaattatgtgtattttattccagagattaagtatcggtacaataaatacatgaaatcattgtctactgccatatgcacacattacattcaactaccctaagcaagtagtgtatccagggatggaaatcataggaaacaatgttatagtttgtttaaataaaaaccaagttgaaacagttcctgggtaatgttaaaggtaggtaaaagtcttcactgctgactctttgggacatccaatttgtaagggagttttgttaaaatgggctaattcctagaaatacacttcctgttggtgaagaaacactactggatgctttaaaataggaaatatttatgttattcaaataaaaataatgctgtgcctttcttatctcttgaatctttttgttagtttttttttttttttttttttttttttttagtgggatatttaggatttttgatgagttttgtttaggtggttgtattatatgaggatgggaaaggtaagagaatttagagttaattgttagcctcccaggcttacaatacatttcttcgtaccttttttaaaacaagaaaatctagagacctagagattattttagaaacaatagaaaaagaagcaagccaagcccctttgctagggaaagtagcattacattttgataaaccttgaagttgaaaatttcctatttcaaattttggtagtttttttttcttttttccctaaagctcttaataactcaggggttcaggttttggattctgttcattgacaccttcaattcatatgagtaatgggcttacaccttagcaattgcaagctgatttgcttgcatgatatttgatgacttttattatatcattaacatctttgtacttaaaaaatattttctctccatcattctctaagagtactatatccaaatatctcagtatgtatatatgtatatacgtgtgtgtatatatatattatatgcatatatgtatatgtatatacacacacacatacttttgttaacttttcttgtatatcattttctagtatatcattttgggtactttattgatcctgccctcacccccagacttttataatttagtttgtaaaactttattttcctaggttgaggcattttaataattctttaatttcttgctatcttactggtacaaacaaatacttaacatttggccatttgatttttagatgattttaaattttattcagtttattgctaaaactgattttcatgtaacataactctgtgttcctgggacgtatacattatttttcctctgagatcctggcacatactttataaaaccttttgttttgagagacaaatttttgtgattttttttctgctaatttatgtaaactggcgacaaaacaaatcttctaaattcattcaagtgtctgacttatgaagtcagtgcctaatcttctcaagtgatagtttcatacagagtctttactatgtaacccctaagtgctttgtaatttttggggggacttagtgttttgggagtatgttgaaagagaatcttgtttttatggattacttcagtattatttaccaatttcaaaatctgtgaatgtcagggttgtgtgtgtgtgtgtgtgtgtgtgtgtgtgtgatttgacaaaagataagtgttttggtattgaagactagaaccgtttcgcctttaataaattattttttgtcttctgaaattttgagcaataattttcttgaaatactacattttggtagatagagtgaatgccctgaatttaaaactattgtctaaagtaagagtttcagaaacttagaagctggtgttatgagacatgtttgtagggaaagaggcaaatccattcattgctcttctagctaattttgctaacaaaatatcttgctaatattttgtttttgaagaacaactattattcagaatgttttccaagaaaagatgcatattttatttaatacagaaaaaataagaagtcctattactggcacgcattcattccctcagcaaatacttagtggtgcacccaccaagtgccagcatggagctagcactggcgatataaacatgagtcagaaattgtgtgtcttcaagaagctggcagtttagtgggagcttaatgactcattggtaaggaatacctgtagtaagggttttgcctttttcacttttctgccagtgtttaaaactctttaggtaggtcttagtatgaattttggtgaaaatgagactaactggctgcatagtgtgctattcgaaaaagtagtggagctgcattttagaaaggatttgggttctcaagtcatcacaaaaagagggaaatcaaatataagcaaaactgtcttttcaaaaagcccttaaattgtgcataaaatactatattgtactgtttgtaggatgagtccaaatgccacttttccacccatgttggaaccaattgcagttttttggtcgaataccagaagaagtaatttgcttgcattaaaaagatatgttttacaaaaaaacttttaattctaagaaattatcctcatctaggtatgtacagtgaatttatggaaattaaatgtgtacatgaagtgaaagaatgatttcttttctttttttctttttaatatcttggtaggatccacgccatctgcccttgttttctgacttgagtggttgaggaatgaattgtgaataattttgaacttgtttgggttttgaaagatgacagattttggttgagtggaattaggatctttccagtagtaggtaagaagcagaggaggagaaaaacacagggcaaaaacgttccatacagaaaggtttacagtgtggtccatctcaataattttgtgtgtgtttgtgtacaagggcacaaaatccacattatagaataattggaaattattttgtacaagggcacaaaatccacattatagaataattggaaaatagagggaagatcatattaattgtttaaatgtataggtagttccattatgaatagtctcctgtaagttttttttaaatgtgttatctcctcgaaataatgctctaaggtgcttaatgctatttctgccttcagcctcattccactcataatgttatactatgaatatttttatttaacccttaatgtaccattagttctgttctttatggttaatagccctatttttgttgttttggaagtctagccagttttatgggaaaacacaatttgctagcctaggaaaaagggaattgaaaaatatattttcatcttaatcccgccttcccttttgttacagccacagccgactggcttccagtgagaagggtggcatcattatatctccattcttccctgaaccctagcaatttatcctgatgcagccactcagctgcattgcagtggtttccaggagcaacccacttacctgcagcccccacccatttcagtcatcccaacatggccaggggaacatagattacattttgaggaccataatttgacttatgacatatctaaatacctgagaaaggacacgctgtccttataggtgattaggtacttgttttattaacacatactgagagatattgttttagagactctgtatgggttatgaagggttaaacttttttgccataatttgtttggagtttagggtttggttttaaaaaatatcatgcagtggtaattggaaaaaattttgtttcaaatttattaataattaagatcttttctatttggaggcttccctttttattgtcttgggtatacaatgtgaacggtaaccgatctacttaattaaaactttctggcattttagcctctttgcttttgctggtttttttgcacataatttgaaacacgtaattattattttctggcttcaggggagtttgtgagaggcaagcctgtatctcgttgttctgattgggaattacacatgactatgaaaaatgggattttactatacataatggcatttaacagaagtagttttatgaaaggaaaatatcctacaaggtaggaaaaaaacaagtatttattaatgcttcattttctgaacttaaatagaattaagctaaattggctttgctttttcctccaataaaataacttttaaaaattcactttaatggagtagttccagagatatattactctttggatatggttatctagtttgcagcaagtatcttgtgatatatagcttagatctcagcaggaaagaaaaaaatcttaatttacatatcagtttctgtatttgtaagaattctgtagcaagtgacagaaacgctgttgagattaatgtaggctaagaagaaatttattgacttacatacattaaaatccaggcatagatcagtaacagctaacttctgttctcaagtgttggtcattagaattattatttggttctcttttcttctgggttggattttttctcagctagactgtcagtgtagcggtgaaggtagctctgaaccccgaagtcatacagggtccttaaagcttctcatctttttggagtctaataacaaatctcatgcagggactttggccctgtgcccatctcttggaccaattattgtagagagaggagaggacaatgaagtgccatgattggtcaggcgtggggacatgtctacccttgcagctgggtataaatagcataatatgattaataactgtagcagaaccccaagacgtaagggagggggagttcctgaaagggtgggatgccgaggaatcaatactacaggaaatgatctcttttaaaacatttaatctctcttacttggaggccagaagtagtacacagttgtcataaaactatcatttttagaaaaacagatattggctgtaaaccaaaactgatttgatttctaggcactgcttttactcaaatatttaaataaaaaattgcttttatttaaaagttatttctttaaaaaattgaaatactgataccttaatgtgcacaatttaaaagtatttcttgtaatttttatttaattttctttaaaaaaattaaataagattctctaaaatcaatgctgttgatttttagggagatggaatactttggaagattaacagtctttggcattgagaaaaatattattagcctagttaaacaattacgtttttaaaacaattttattctaccattttgaaaatgaaattctaaacgaattactttccaaggtgttttgcttttaaaacaatggtctttttaaacacaaattgagacaatgtcattattgtagtatttctgagggctccctaataatactttttaaccatgatttcgtggaaattatgtgaaaggaactacttcactgactcttatataaaatgggtatataagagttttgaaacattacttaagtatggtgtcatgtggtaactgtttaattaccaaaaatgttatttggcagatattgcaggataaaatctgatcccctttttaaagttttttatagcctccactgggagaacagaggtactcagagcaggggtagacagttgaaagagaggggtgggtgctccaaataacatttcatactatttttatattctattactgtatcaatgtcttcagctttggtgccataaaaataataattttagtaataactttgagtttatatatgccatgcacagtaggagttttgtagttttgccaagtgtcatctggtagttggatctttagtgaatattaaatgttggtagattattggtgaatgcacttactgtacataaaaatgaacattcatggaattgggtgtgatttgccagtaagaatcatcatagcaagtactttgtattgttagattagtttgggcacccttcggatgactttagaccatatttggaaaattactgcttctacttcaaaagcctgtaataattagagttctccaatattaattccatatattgattaattaagccatgaaatctagtaaaatgatatagtctttattacctctgttcacagaattgtatctcaatccaacttggtagctttcagcagaacactttgtcaaaatattattaattttagctaagaattctattcactaatttcagtgtttaagttagaatgcacatgctagtgaaaattttaatttcctttgaatagaattagatttgctaactagagcaatctcacaatgtaatgctgatgactgaaatgacacttcagcctcccttgggtgacaaccctaagtttagacaaccttactctaataggaatattgaggacttatcacaacatattagctgtcatttagagtaataacttccatgtcagggcattttatacctgtcttatttggtttataaggatgtatatattagcattcatgttttcttataaagaactttatatatttttattctctatgagtcagatattatcatcttcctttacacatgagaaaattgagttagagagattaacacgtgaaagttcacacagactcacaggaagaattatgaactgacacagcgttgagtctttctttactttctggatagaatattagttcattatatccaaaaaacctgtcttcctttttctagtaaaaggaaaaagcacaattctgaattgtttgcgtgggtgttaaatgcagtaaaacactgggcaagtacttacaataaaggcttcactgcttggttctgtttcaaaacagagtttgtggccgtgcagtttaatctgtacagctaagctgcatgataaagtagttatttccaagaattgctaatcaagcagaaagttagtattcttgctacatttgtaagagaatattttcagcagaatatttttattgcggaaaatattctctataatatgtaaaagcccagataaatatattagatacatattttaggataaatatacttgggaaaattgcatattagaaataatattttgttcttgtgtttcctttctacttcctctgtaattcactcaccaggaaggtgttagcacatttactgagagcctagaaaatgttctggtgaatgtagaaaggaacgtactttagaattagggatcttttataagtatgcagacccttctcacaaaagtacactttgcttgaataaaatttagctaagctaggtaaaagaataactcattgcatttaagtagacctttctccttctagacttcgagtattgcacacctaagatggatcctttgaagaggcaggtaaagcaggttgtggattgttggaacctcttattctttaagtgtttacgctgttatgttttctctctgggctaaagtcagtcacttgagtggaaggaaacacagcaatccaatcttagtatatggataaacaattcgaggcttagcaatggcagaagtcatagcataagcatggtagagcagagactagaactcagattgtttagttcctttcattgttctagtttctggcataagaatttgtgtagaaaattggcgaaaaaaggacctgttaaacatattctgtttctttatgaaatctgcattctcttggaactaagtgtaatgtgctagactcagtttgttaggccatcagtgtgcatgaatgtggttagaggcagtggtatccccgaacctgcagcacaggaaagaattttaatcattatatgccatggattttcagggcattttaagcctttataatggtgtaacttatgattaagatttacacagtcaaaattgttagctggtataatagctgaatagttaagtatttattttggttagttactttagctttagctttgaaaaatcatttttcctatcggagattcttcacaatgctttcagtaaaatgtttctgaatagttcctgctatatggtagactgctaacactgtttcttgctctctctgtggggctgatgctacaagtctgatttagagtcagctgtgcttttatttttttccttgagtgactaggggatgcattgggggaagataaattttagggcaagaggacactcagggttgtgggagatgaactgtcaaggatacctttggctcactgtcctcaagcttgttcggctgcagtgatggcataactgagaagagggattgtgctcttgctgggtgcgggacaagaagatgtctcaggccacgtaaagctggccacagcagaggacaaggtattccctgtgaggcaaaactgaagaaaggggattgaggtggcagttctggggaaactatgtttgttaggtagactaatgggaatgatggagtcttgcttgggctctttgtaggtcagtggaagaacagcatgaatgtggacatgaaaaaatctttctgcaatccatttaccacatactcctttgcaatatcagtcagggttcagtgcaggaaacagaaggggatataatgcagggaattaattgcttagggaatcttttgaaagggctggagggctgggctctagactgagcctctgagaatgatttccaggacaccttgaaacagtccacagtgggagctgccacctctgcttgagtcaggaaagtggcaatcaggaggttgctactgaaacagtggcaagaaaatgctactgtagctgtgatccaggtgatcagggcagccactgctgttaacattgtaactgctggaagtctggaatgtaggatctggccattgctgtgacagcttctccttgatgctcgtgaactggtgactagatgctgttatgatgaatctggtccctgctgcctttgccattgtctctaaaataattagaaaatgattaattatgtttttaatataatttaattgtaattttatgcaactaaattcttaatagtggctgtgtttgacaactgatttgtgaaattcataaaaatttaataattggccttgcaagagagtacagccaactccattgcatcactgtaaaacctcctagctgacggttctactccttaattgaaaattctctcttttttgttttagttcaaagctggagactggatactgacatgttcatgaccttgtgtacaagctgaaagctgctgaaagctacaggccaatggggctctgctttacttctgccttccatatcttgtgtcctgcatcttaatggtggaatcagatttgcatccagaatactagctataaaggagtctggaaaagacagtttttagttttccaacttctgcgtttcaggaaggcatactacaaggaggaagtcgctgagtgatagctgatcctttcccaggcactcatcttcttaaacatagtatattaattacaatttagcccattcttgatggctcattgtcatttctgtgagcttctcttttcataatggcctgtagttggaataatcatagggccaagggattttaacatctgtagtaactttttgtcctaggttagcttgtatctctcccacctcccataactgctgctgagacatctatgtttgatatcatttgacgtcaacctcccctgcaagccacaggcagggagagcacctcacccaaagcaaccagtttattggctggtcagcaacctgtgatttctgtagcttaaaaagatgagtggggcttattgtcttttgaactaagacaaaaaggaaagaatttccaattaagggtgggagcttcagctgagaggttttgaagtgagttggctgtattcttttgcaagaccaattgttaaattttcaagaattttgtgagttgtcaaacagccatttttaagaattaagttgcataataatttaataaaaacaaagataaatactcaaaacaaattatttcctaattatttgcccacattttacaattatctatgcttttgaatttctttatatctactatatctgtatggtagaaacactatatagtggtttgctactgtgcatatcttcccagctcccttttcactgttatcacagttgactatggtggtagttgttggcatttcctgaacatatcacactgattgtgggggcggggagggagaatcaaagttggagaggtcatgagaaaccatgtacaaactaaaattatgggagaagaaactatgagtgaaacgatgagaaaaacctaatgcatgatgtagaactgagtggtgttaatagcagagcactggagggaagggccacaaaactcttcaccccaaggtctagaatcattctagaatcatcctacaagcctagttttcatgagattcagccctattttatttcttgctcttggaattatatgaaattacgaatttctgtgtgttgccagctgtaatagaataccctggaattttatttacttttaattttgtttatttatttatgcttatgtgccatcttctcatgaaaaagaggcagtatgttaaaagtttgagttcagattttctgatgtagataaataagctaaagaaggcagggtgaagtgtgatatatgagaatttccagagcagggtattcgtaacttgtaagtatttagtccaagttccctctcccaacacattttacactagaataagattgaaaggccagatgtggtggctcacgcctgaaatcactttgggaggccaaggcaagtggattgcttgagcccaggagttcaagaccagcctgggctacatggcggaaccccatctctacaaaaaaatacaataaaaggtaactgggcatggtggtgtgtgcctgtattcccagctacttgggaggctaaagtgggaggatcacttgaacccaggcaggtcgaggctgcagtgagccatgcttgtacctgcatactgcctgggcaacagagtgaaactgtctcaaaaaaaaaaaaaaaaaaaaaaaaaaaagactgaaggctgtcttgaggaatgccacttataaatacatttttaaaaattcagtaatatttttcatgtataaacattgtggagactattgtagttgcttgtacaatactggggcattggtgatatctgtctctttactattgtagctcctgcctacgcctttagtaactgctaaggtgcagactgtagatctggactgtctgtgtctgtggctcacaacctcaacttctctgctgcctttgatttgctccctctgcagttttgttttctctgtactccgattgcttctcccatgcttctctgctttccaaagaaaaaactgaccttgtatagatcctgtcagctgattgcagtgctcttaacttctccattgtgagttgttcagtctgaggagttaggtataaacccagagtggtattctcttttctgttgtgtttggttttgcttacatattcaggagctgctctttacccccagaacatccgtatatatgtttttttctgtttctagatttaaaaatattccagaagcctggcctcaagatagataatattttacttttaatttggtgcccttgttttagagatttgaactggattgcatttagtaaaccaaaccccatctttaaaaaaatcatcttaaaaaaaaatagtgggccggacatgatggctcacatctgtaaatcccagcactttgggagactgaggtgggaggactgcttgagcccaggagtttgagaccagcctgggcaacacagtgagaccttttgtctacagaaaaaaaaaaaaaaaaaaaattagccgggtgtggtggcacgtgcctgtagttccagctactcaggaggctaagataagaggatcacatgagcccaggagttggaggctgcagtaaattatgatcgtgctactgtactccagcctggatgacagagcaagaccctatctctaagaaaaaaaaaaaaggaaaaaaaaactggttcaaattggatttttctattctttcataagatgataaatgaaaaaaaaaagaaaatagatttttgaaaagcaaataatctcttggaatttcttattaaagtataaaaaattatctaattgaggcatgttaatccaatattaaagtattaaaggctgagtgtggtggcacaggcttatagtcccagctactcatgagatttgagaccaggtgaactgcctgagttcaagaccagcctgagcaacatagtgagaccctgtctctaaaaacaggtaaataaaaaaaaaaatttcctctgattacaggagataggtagaaaaaatgtgttacagtgcagatgagaatttccttagcacttttaatgtgaagtttatttagattgggtggccagggaaagcatccctgaggaggggacatgtccattgtgagttgaatgactgggaggcaggcatctgccctctgaaaattttttactcagagagaattgtaaaacacaaatatgagaacctggttcgatataggaatagaaaggctgatatggctggcaccaactaaatgaggggtgaaagtgagagggatcagattgaagaagtagacggggaccagtgggggtctgttagccacagtaaggggtttggattttatttattcttaatgccactggaaagtataaagttggagaatgattggtatgtatgtcaaaaagtcattgtttgtgatgtggaaggagggcaagagtggaagaagggaaaccctttagtttggatgaaaataaatgatggcttggacttataagaatagtggcagtgaaatgaagtggatagatttgagatatgtttttaaagaggaactaaataagacttaactgattgattgcaggtaaggaagggagaggacttcaagagaacctctaggtttttgctttgagtaactggtggtggtactatttccaggaataggaaagacaggaggttgggtggagtgatcagattttttgtgtgaaggagatatatctaccaccaagattattttcttaactttttactgtacttgctttattatacattaacctattcctccatccatcaatctgtcttttttttttttatgcctttcaatgtaaattgcaatgcatttccacaagaaaggcttttaagtgcccagtttttctaattttacagatgagaaaactaaaccttggagaaaaatatgctcaaggtcgtatagctagttactggtgaatctaggatcagcatgcaggttaccattagttcaggactctaatttgattatattttagcttgtaagaataaaagtgaaatttggaaatgggacaagttttcccacgaactcgtttatgtgctaaaatatcttagacccaaatttctatgtcaaaaatgcaaaagatgtagtactacagttgcatttgactggattacaatgttagcacggcacttaggacttgttggaaagtaccttctaatgttgtagaattggaacattttcagatgtttggttcaggaaggtagcttgggattcttccaagcattaatcctcttattggcaaggcatttggattttaattagcaaatgtgccttgcatacctactatgcactaagccccatgcaaggcccagataccataaaagagaatgattcaagttccgtacttcaaagtaattcagcctttgacttctgtgtcaattttctgaaatttctctttttttgctgtatgtttgtttaaaaatataataaaaactgaagttcagaaaggaagagaagcttattcaatctaggcaaaacttcagcctccttgttaaaattttatgcatatgactgacataggctactgaattgaatcaatagctagtagtgtgaagggcaaacagatttttcatttgctttgtgtaagcactttattttccaaggagtgaaaataagctgttttagtttctgtcctatggaattaactagctaggttatcagttaagttggtatccaacctggaagttaatgacttaagttggtacagaaatatgagacatgtttgtctttaaaagtcaaactaattgtctgtctttaaaagtcaaactaattgtctcatattgatattatttttatgctttcttgtaaaataaacattttcactattgagctctgagaatttggattttgaggaaattaacccaatagagcattatgttctttccttgaagtggtcattctctgttctaaaatttaatatcctccaacaactctctcagctcatatcttcccaaactcatttcccattagtacctaatatgaatactcagttacagccaaagtatttgttacacatcttcaaaatccagtcctaaatttatttcctttagagatttttctaggattaatctattactttttatttctgtatttttcacccccaggatacctaaatagttctgtactttgccatatattattattaattttatagctatttagtgcagtaatttagacctacccagcagactgtagtgataaaattgatctatttattactgatgctgaaaaaaacttagcaaatttaagttaatctgtaaacactttctatactggaaggcatctttatacctttgacaagaagagtttctctttggtggaaagtttcaagaggaacacacatgggttaaaaaaggatctgttctttttttttttctttttttttccagttcactctcccaaatttgacaaggaaaaagagaaatggaatggaatttagttccttgttagtaagaattagaaaagtataaaggtagaggagaccaaaattgacatcaatttgaatttatttgggatatatctttcaactagaagtttacttttaaaaatcttctctttttggctgggtgtggtggttcacacctttaatcccagcactttgggaggcaagcaagaggattgcttgagtccaggagttcaagactagcctgggcaacatggtgagaccctgtctctacaaaaaattaaaaaattagccaggtgtggtggtgcatacttgtggtttcagctatatgagaggctgaggcaagagaatcacctgggcccaggaggtcagtgctccagtgagtcatgttcaacataggtaagattgtaaagtgaaattaacatttggtaccttgttactttttttctcctatcccattctcatttttacttcttggtattacttttctgtgtctgcacactgtctcctgactgtctagtctcagcatcctttcttattggcacacactatcacttggcatttttccattgtgtaataggtgggtgtcaggaaagttatttgattaatctgttctatactaggttatactatactgatgtgaggaattatcactgctaaacctactcagggatattttcctcttaacttcctgtgtgaccccaaataacagaatttcaagcaaggctgtaggaacttttctgcaagtcacgccgttaaacgtattctgcctaatgtaaatgattctggaaagtatgaggaagatgttagtggttcctagcctcgtcttttatcaccacatttcttcaggcagctccacttctcttgcctgaagatggtctttctccatgtgttgtttttctctgtgttcttaccagagtcctctgtaacagtattttgttgttcaaaataaattcattacggaataccctgcattttgagattctttgtatatactgaaatataagtcagcttcatcttttctgagtgacaattcttttgaggcattgggaagcctcttatattagaagaaggtctagagcctggattttggttcttagtcctaaatttgaatcctaggtctgccacagttctgtattcaaaagttccataaagaatcaggacaaaaaattgctactaaccatttaccacccagaagccataataataattaattttatttttcttttactattttaaattattttggctgtgaccgtcctagacgtgtgaatacatggtcaaaaaatgtgaactttttgggagatcttgataatgttacattgtatctttctggctctagagctcttacatttttcatactaaattgtctcagtctttggggctttattattattattattttattggcagtgttagatcttgtagccaaaaaaagatttttttttcctcttttggttccaaatagtcatctgttattttggattatttgctggattgttaactatacaggaaacttccaggcctcatctcacagcaatgactgtcatgttgataaacaattatgatatcccaggttatgttaaccctgcctaagtagttacatggcccagtgaggatgcctagtagctataggtgattggttctgttttgtctcctacacctaaaattttgccataggtaactgttttgataaacataggatagcgtccttttattctgtatgtaaaaaagtactatatgtaaaaaaggaacttaactcctcactaccctgtttctgtcctctagacagccagatggatcttgtgtaaaagtagaagtaatcttggctatagaacaagaactgttgatatttccattttaaaaagttgaatcagtcttaagtttgagttggtgagtaaaacaaaaccaaaaccaaacctgggataagctaccaataagttaccaaagtatttaaaaacttgacagatgtaaaacattaatatataatttattcttagcaacttaatctgtttattgagtggcagtgtttcagtaataaagctgagctatttggatacactgaccttaatctagtggaaaacaggaggcttttaaattggcacatacacaaatcatcttaggatccataaaatgccttattgttaaattactgtttttaagtcttatattttctctgactacttctgatagtattagtaggcatctcttactgtattttttttttcagaaggcaaatttaggccgtttttataaggtgaatataggtagattttcatatgtattctggtatattgggaattactgccaatgattacttcccagataatccattctaactatcgagtatctagaaatgatatgttttaagtcacgatgattattaaaaaactgctgaattaaataagctacacattttgctggaaattaaacaaaacttactcgcttctttgaaggaaattgatttattccttgatttcttctctgaatcttgaatacaaattaattttttggttttttttttttctataaaagtgaacttggagaccagtatagcacaatataaagcaaggaaagttaaaatcaattaagaatgctttgtttaaaaagagagaagacagaaaatgtacaatttgtttgtgaaagaattccatagaaataacttatttatttatttattttattatacgttaagttctggggtgcatgtgcacaatgtgcaggtttgatatataggtataaatgtgccatgttggtttgttgcacccatcaactcgtatttacattaggtatttctcctaatgctatccctctcccctccccccacccccgacaggccccagtgtgtgatgttccccgccctgtatccaagtgatctcatggttcagttcccacctatgagtgagaacatgcagtgtttggttttctgtccttgtgatagtttgctgagaatgatggtttccagcttcatccatgtccctgcaaagttcatgaactcatccttttttatgactgcatagtattccatggtgtatatgtgccacattttcttaatccagtctatcattgatggacatttgggttggttcccagtctttgctgttgtgaatagtgccgcaataaacatacgtgtgcatgtctctttatagtagcatgatttataatcctttgggtatataccaagtaatgggattgctgagtcaaatggtaattctagttctagatccttgaggaattgccacaatgtcttccacaatgattgaaccaatttacactcccaccaatagtgtaaaagtgttcctatttatccacatcctctccagcacctgttgtttcctgcctttttaatgattgccattctaactggcatgagatggtatctcattctggttttgatttgcatttctctgatgaccagtgatgatgagcattttttcatgtgtctcttggctgcatagatgtcttcttttgagatgtgtctgttcatatcctctgcccgctttttggtggggtttttgtttgttttttttcttgtaaatttgtgtaagttctttgtagattctggatattagccctttgtcagatgggtagattgcaaaaattttctcccattctgtaggttgcctgttcactctgatggtagtttcttttgccttgcagaagctctttaatttaattagatcccatttgtcaattttggcttttgttgccgttgcttttggtgttttagtcatgaagtccttgcccatgcctatgtcctgaatggtactgcctaggttttcttctagggtttttatggttttaggcctaacatttaagtctttaatccatcttgaattaatttttgtataaggtgtaaggaagggatccagtttcagctttctgtatatggctagccagttttcccagcaccatttattacatagggaatcctttccccattttttgtttttatcaggtttgtcaaaaatcagatggttgtggatgtgtggtattatttctgaggcctctgttctgttccattggcctatatatctgttttggtacaagtaccatgctgttttggtcaccgtagccttgtagtatagtttgaagtcaggtagtgtgatgcctccagctttgttctttttgcttaggattgtcttggcaatgcgggctcttttttggttccatataaactttaaagtagttttttccaattctgtgaagaaagtcattggtagcttcatggggatggcatttaatctataaattactttgggcagtatggccattttcacaatattgattgttcctatccatgtgcatggaatattcttccatttgtttgtgtcctctttaatttcatcgagcagtggtttgtagttctccttgaagaggtccttcacatccctggtaagttggattcctaggtattttattccctttgtagcaattgtgaataggagttcactcatgatttggctctctgtttgtctgttaatggtgtataggaatgcctgtgatttttgcagattgattttgtatcctgcgactttgccgaggttgcttatcagcttaaggagattttgggctgagacgatggggttttctaaatatccaatcatgtcatctgcaaacagggacaatttgacttcctcatttcctaattggataccctttatttctttctcttgcctgattatcctggccagaacttccaacactatgttgaataggagtggtgagagagggcatccctgtcttgtgctggttttcaaagggatgcttccggttttagcccattcagtatgatattggctgtgggtttgtcataaatagctcttattattttgagatacgttccatgaatacctagtttattgagagtatttagcatgaagggctgttgaattttgtcaaaggccttttctgcatctattgagataatcatgtggtttttgtcattggttctgtttgtttgatggattacgtttattgatttgtgtatgttgaaccagccttgcatcacagggatgaagccaagttgattgtggtgcataagctttttgatgtgctgctggattcgttttgccagtattttattgaggattttcgcatcgatgttcatcagggatattggtctaaaattctctttttttgttgtgtctctgccaggctttggtatcaggatgatgttggccttataaaatgagttagggaggattccctctttttctactattgaaatagtttcagaaggaacggtattagctcctctttgtacctctgttagaatttggctgtgaatccgtctggtcctggattttttttgttggtaggctattaattattgcctcaatttcagagtctgttattggtctattcagagattcaccttcctggtttagtcttcggagagtgtatgtgtccaggaatttatctattttttctagattttctagtttatttgcgtacaggtgttcatagtattctctgatggtagtttggaatacaaattaatttttaaagaatgttgagtcttctattttattttataaaaattacaaaacatgatataaaaataaaaaataaaatagttacatttactacttagtattaataataaaactgtttggtgggttaatttatttcaatccaagctaacatatattactaaagcagatttaaataaatgatgcttatgtgtaagacactgctggatattataaaagactttagagttccttttatacctgtaacactaattccaattattatgtgaaatttggtatataattttcctaatgagatgacattattatcattacaagtttcacagtatttgtataaatgtgttactagaccaaataatgtaaatctgaggcaaatctttgcatttatagaaactagagcaactttaaattccagatcctcttccctataatgtttttagtagctttcttctaagtgctttgccagtaggacctttagtagcagaagtaatactaataaagtaagcaattatagttcaagcagtctttctgccaaaagttcattcacatttaaaggaaagtaggaatgttgggtgtttttgaattgtctatgccattgctttccagactgattaaaactggcagaaattactcagatactgtgaggatgaattttgtaaccatccccattccccacgcctgatagaacatctaacactaattggctattttcagaggtttgtgtataccagcaatagttgagaatgaatagtttctcctttttttcctatcactttctgcctagattgctttgtgatggctgtgatcttcctttgcctctcttttctatctctccgctcctattatactccagccccaatatgattcttgagcatcacttttgtttagtcgttcctgtttttttccaaatccatgatgatatctcctattgccaactaaaatcttcagtttagcatgcaaatcttacaagtgtggacccagcctactcttccagcctcacatccagttattctctcctacaccaatgacaatggtctgtttctcaccagaatatgctttgtacttctttttaagcttcaaaagttttagtatgttatctccttactccctctcccaatagctgcaccttctgtagtctttaaatgagtgcgttttatatttataaagtcgtactgtatatatagtattcggtctgattatggaggatttgaaagctagtcagatcctaaagctagtgaaagtagccaaatgtttttgagcagggggtcaaaaacatttatatatattaattatataattaattacatatattaattatgtaattaatgacacatattaattatgtaattaatgacacatattaattatgtaattaatgacacatattaattatgtaattaatgacacatattaattatgtaattaatgacacatattaattatgtaattaatgacacatattattatgtaattaatgacacatattaattatgtaattaatgacacatattattatgtgtaattaatgacacatattaattatgtaattaattacacatattaattatgtaattaattacacatattaattatgtaattaattatgtaattaattatgtaattaattatatatcaatcatatattaattatatattaatttatattatattaatatattaataatatatattaattattaattaattaataattaataattaataatatatattaattatatatgatttatatattaattatatataatttataaatatattaattatatataattaataagggaatatgtgattaatctggcactgatgtgtaagagacactagaagagttaaagattagcgtggaaaccattaaaggaagagtcaaatttcccaggataggtagaactgatgcctgggatgaggaagagatatcaggtatcaaagttaacaaatcttgagatacagataatgacagaataagggagattatgaaggagagctggttttaaggaggaatatgatttagattttaaataggtttggttgcaatgatgatataaatatggacttcagattagaacctgagcattaagacttatttctcaaattcagaatggaatgcttagagttctattcaaataaaaacgacaaagttgcatatttattaagaaagtatttgttgctgggagagtggttataaataaagtactataaatagtaagggtgatattagcatatactttgtttctaatataatattaagtaactattgaatcacctttgactaattgtcattgaattagcaattagtaattgattttttaaaaaacttttattttaaaatttcatttattttctttttttcacttctccattgttcttttagaccttttttaaagtgtcagatttattgagtataatttacatacaataaaattcatctattttaggcatatggttatattagttttgatgaatgtatagagtcatataatcactatcccaatcaaaatacagatttcaaaaatcccccataaaattccctggttcctccctgtaggttggtgatcttttgagaatgcaatttcaccttataatgtatttcaacgaaataaaagttttcagttttaaacaatcaaattattatagaagtggattttggagtatagccacgtcttaaattggggaccacatttattgatttctgatagattaatttttattttcagagacagggtcttgctttgtcacccaggctggagtgcagtggtgacatcacagctcactgcagtcttgaactcctgggctcatggtagcttaatttgaatttcttgtatttaactgagcaatttaagaacaggacttaatgtaaatctacacttttactttcctactccctcctcccctatcctttttcccatttaattttctgcctaaaatcagtttcttctcatgatctctgtgttgggctatgtattcctcctgtatatgtttcttccctcattcatagcatttatcacactattataactgatagttacttgtctgtcccgttagtctgtaagtctcactgaggtgcttcattgtcttgatcattatttgatccctatcatctaactcagtgattggcatagtaggtaatagatattttctgaatgtgtttttcttgtcacctagactcaaatactttagaataatattagactctttaaagcctcttcctaaaagaaagaaaacctaattaccaagttttatcagtttttctttctttataatattttttatatcctcatccattcatttttattttcatattcacttccttgtctgggctttttcgacctaagacctggggtccttggtttcagtcttttgtttttgttttttatcttgtatactactgctatttcagttttgtgtaaatttttctcttattcagaaagctcagtgggatctgtgttgtttaccacagaaaatgtaaacttatgtgtctagcattcaagacctttatcatttatttaaaaggttttagtgtctgataacttcaaatgcactgtgatgggtgatttgttaggctgtgtagtttgtccccaacccacttttcctgttatctttttctacttccctacttgaaattttccacagtgtctaatttggttgcttacttttctctgaacatgctttttgctttccagccattacttgtgctatttcactaatctggtatcttcttcttttccatttctttctgagtcttacccaaatcaagtcccaccttcaacatctttgaccattctattccatagagcactcccttttgacctcgtttaggggatttaactatttatgctattcatttgtaatactgccttgtagtcttcttctttctctttttttaatttataaatatgccatcttcttacacaagatggaaagcacatggagtttgaggaccatttcttacatgtgcttgaatctcctgctgtctttaacatagggcttgtgcctagtggtcctcaataaatatatatttgattagagtatttagacacctgtttgcacttatgtatagaaaattaatgagagaatatgatagtgaatcattttatatctgataaaattccaaaatataatgactagtacactaaactttagcatctatgaacagaagtgttgtagaacaactttaaagattttaaagtgaattttacaggaacaatatatattacagtacatttatcaaacacttatttttttgctacatcattgttttcctggaagaaattaatgttggcagataaagctattatataactaaatattttgtaaaaacatttggcttaactaatgcagtacttgtttaattgatttttgatttttataattcttataatgtaaatagtttacatgataagtaaaagtaaatatagagtttagggggcccatttttaggaaattttaatcatacacattatatagggattttctacttttatcttcaatatccacattagctttattaattaaggagtcatatgactgaaagtctcaattgagaagtcatttatcgaatctacattctgtactcttaaatccttatagatgggaaaaacctggggactctacaggttaacttatatttttattactcagtttgggaggaatagaggaatgaggcctttttatcttttagaagatcagaactgttcagagttctgaacagttgtttcatttcaacttgatattgagcagtgaactttgtgattatgcttggtgagggcaagtaaaccaaatggatagggctttaggcatctttgttggagagaaagtgtaagaggctcttttgggctgggggtgtagagtgcagggctaggaggaagagaaagcatggagttttagaaaaaagaaagattgggaatatcccaagagcaagaccttgtatttttggagagtggttggagacatctttttcttcttggtttgcaaagagagtgattggtttccattactgctgtaacagattcccacaaattcaatggcataaaacaacatagatttattatcttacagttctggaggtcagaggtctaagtgggtatggagggctgcattccttctggaggcgctagggaagaatccattttcttgcctttttaagtttctagagcctgcctgcattccttggctcatggccccttcttccatcttcagagcgttatcagtctagcctctccttccgttgtcacatctccttctctcactttgaccctcctactaccctcttagaaggatctttgtgatgatactgtgcagtccaaagggatagaattagaatttgtgggtggaaattacagagacagatttgtactcacattaagggagaactttctaaccatcagctgtaaggatggagtgggcagtctcagaaagcagcagcatgtcctagacattggcagtgttgaatagaggatgaacaacctcttcccagaattgttgtagataggatctataaacattggtgggtctacacgagccttagacccttgccaaccctgagatcaaatgattctctatgcatagctcagtgctattataatttggatatggaacaatccctgccttaaggaattcaacttttactccattagttgctgtattgctttattgccccctttcaatacaacagtaaacataaggcctaaaagaaagactgaaaacaagggctgtagatttaggaacctactgcttagacaatcaaacctacttttgtttgatgaagttcttttgggttaaatatattttcacttgttttgaatgactcattcttccattcaggtgaaaaatactcagactttttaacaatttgaatggatggcattcctaaaaagttatgtggaaaggagtttgaatatttaatcttacacttttccaaataggagaaaaaaaattttttggaatttaacaggcctatgtgaaggctttaggtgaggaacatagcgtccgttcatctgtgttgaatatttcatggttttgattataaccaaccaatatgaaccaatttcagtagttttagttgagagatctagttagtagttcactttcaggtagactcaaaaagcttttctgtatctcagggaatacaagtcaaatgtctgtacatggggggagtggcttttataagctggtagtcagtgaatattgcattgggagagctgaaaaagtttatgtactttcagacatctcataatgtattatgtagcaaatttgttttctccatacgtttttaatgaccttatagattaaaactttttttttttgagagggctaactgtatttttttcttgaaaggtatttttgctgaaacagagtgaaattgaacatattttctaaccagtctggcatagtgcagcatcatggtatttaccttttttccctgaggctgttgtgcctcatgttttctatttaagtatgacttactaatgatacacaaaaaatttccatggtttctgtagcttcttccttatacttcaagcctgtcccacatggtaaatatgcttaagggtcctcttagataaatccaatgtcaagttaaaaattttgtgctattcatttgacagtgaaaaagagatagtcccatttgaggatatgaccagagtataaatcattaagtaatagtattagaaagggctttgacaagttgtctcatctaactctctgctttaaagaggcaagtgacctaattcgttagtttcctcaaaatgcagactctaaaccgaggtttcataaaatccaggctttagagccttcaagaaccctctgaagctgcatgcaaaatttctgtgattgtgtctttttatgggatgagggtccatcaacttttatgtattcattcatgaattattccctacctttcttcagtattttaataaatgttatgtgaagcttgtaccaggtacttggaccatactcttaatatatgattcttcataaacttgatcttttgttttatctacagccagtaggaagtagccaatcttaaaacaaggaaccagatataagggactatggctctgtaattacttctgtatttgctttgaggtgtatttctggactgctcttggattcttgctatacgctaatgtctgaaaccaccttgatttttttttttttcaatctatatgtgtttggatttggctttgcttactgattgtctgatgtggaatttggtgacctggatgctggactgagtgctttcttagaattcatgttgtttttggaatttcacctcttatcattagtgtgaactgactttaaaactttatgtaaaacatgccctgcccatctctctctctttacccttttactgactgtaagggagtaagcttagatagcaattcttgttttttatttaattggaacttttattgagctaactaaattcacatgtagttataagaaataatagagatcttgtatacctttcccttagtttgcaccaatggtaacattcttacaaaactacagtataatatcacagtcaggatattgacattgataccaccaatcttaacagatttccctagttttacttctattcatttgtgcatgtgtatgtgtgacagcatccttagggtgttgcttcactagccggaaacttctgtgccggtggcacctctacttgagttttgctcgcacctgctgggctcgttctgcccacttggcctgtcaggctgcgtttggctcatgatgcctgcccggatcccatacctgccaagggtgagccaggacagagcggtgaggggcatgtgagtgagcgagtgtggggtctggccactgcgcacagacaggcatgccagctgctgcggggcagggtggcggggcaggcagctcccggcgctggcacaggcgcctgctccgtgcaagggtgcatctataccagacataccgcaagcagcttctgctgcgggcactagtgtctggataagggaacgtggtggcgcctgaaagctgagagataccaggaacagcagaaccctattgccctcagtgtggcgagtgggggaggcatgtttcggggggcatgttttggcccaattgtgttatagctctttcagtctcactacccagctctggcttgcagctcctgggctgatccggccccaccgctacttcccattgcatgtgtggctgcctggtgcggtggagggcgggagggctatagtgttacagaaactctggcttggggaatcctgaggtctgggcccccagaagggttgccacccttcacttctgcagtctgagagtatgtcactgcccacagcttggtgagccgaccaagaatgtgttacatacccctttggctcctgccattcagtaggtcctgagttcttgtcccacatccaggaagaatgagattatgtggacaactagaggatgagcaaggcagagaagaactttattgagcaacagaacaactctcagtggagaagagacccaaagcgcgtagttcctatctgcaggcaggttgtcctggtaagtattcgtttttttttttttggggggggggttgtttttgtttttgtttttgagacgtagtctcgcacttttgcccaggctggagtgcagtggcctgatctcagctcactgcaagccccacctcctgggttcacgccattctcctgcctcagcctctcgagtagctgggactacaggcgcccgccactacgcccagctaattttttgtatttttagtagagacggggtttcaccatgttagccagggtagtcttgatctcctgacctcatgatctgcccacctcagcgtcccaaagtgctgggattacaggcgtgagccactgggccctgctgagtctgggggtttttataggcacagaagggagaaagtgtgtgctgattggtccatgcgcagccatgggtaggcctggaaaaagcaccatcccattggccaaaaggcatcaaggaagttctcactcctagtctcagactccacccggtactggcagcccggcctccaggcttcaggccttcccttgcttgaaggtgaggtttcaccagggaccgtccctttcccgcctgggaatctgtctgccaggagcctcccttccatgcttgttggcatccaaagtttcagcctcagaagcagtttctggaggggactgaggtggcgggtggggtgggggcggggactggtgtgtcagcgccaccccaagtgcttgcacacccggcctagttgtgagcctgggcagggagaagccagggagcaggtgcaggcacttctgagcccacgggggcagggggtttcccgccctgcaagagcgcaaggatacccagtctggagctgctgctgggcggcacctgcactagggagtgcgggctcccactttgccaactcagtagggcgcaggactcctgctgggatcacctgttcctagcccctgccagctccaaggagtgtgcagctccagccacccccgccgcctgcccccccgccccccgctgcagctggcatcctcgcagtgaccactccacatgggccgccactgacatcatatgtatatttagttctatacaatgttgccatttttgtaggtttgtgtatctagcaccacagacaagatacagaacagttccatcaccaaaagcgtccctcttattactgctcttttagaaccatacccacctctttgccacccctccttcctaccccacatccaggaagaatgacattatgtgggcaaaaacaagagcagtccagaaatacacctcaaagtaaccactaatctgttttctatttctataattttgtcatttcaaaactgttatctcaatggaattatgtgatatataaccttttgggaatggcataatctccttgacattcatccaagttgttgcatgtagcaattataccaatttttcattactgagtagtatttttgtttaacattcacttgttgaaagacatagactgattccagtttttggctattatgaataaagctggtatgagcattcatataaaggttttaatgtgaccataaattaaaaggtaatattggctcatgagttgggaaacgttccctctttttctattttctagaagagattagcacgttatgtaaatctgggaccaggtgtggtggctcacgcctgtaatcccagcactttggggggccaaggtgggtggatcacctgaggtcaggagtttaagaccagcctgaccaacatggtgaaaccccgtctctactaaaaatacaaaaaattaaataagtaaataaatgaaaaattagccgggtgtggtggcaggcgcctgtaatcccagctacttaggaggctgaggcaggagaatcacttgaacctgggagatggaggttgcagtgggccgagatcacgccattgcactccagcctgggcaacaagagcaaaactccatctcaaaacaaacaaaaaactggtattaatttttgtttacatgtttggtaaaattatccagtgaaataggctaggcctggagatttcttttttcaaagcctttaaattacaaattcaatttttttttttttttttttttttttttgagacggagccttgctctgtcgcccaggctagagtgcagtggcgcgatctcagctcactgcaagctccgcctcccgggttcaagccattctcctgcctcagcctcccgaatagctgggactacaggcgcccgccaccacgcccggctaatttttttgtatttttcagtagagacgggatttcaccgtgttagccaggatgatctccatctcctgacctcgtgatctgcccacctcagcctctcaaagtgctgggattacaggtgtgagctactgcacccagcctacaaattcaatttttaaaatgtttataggactattcagattttcttcatcttggttgggtggtttttgaggaatggtccatttcttcaaaattattgaatttatgagtataaaattgttcataatattcctttattatcctttaaatgactgcaggatccgtcgtaatagaccctgtttcattcctgacattggtgatttgtattttctctatttttgtctctatttagtcttcctacatagaggttactaaattttgatgtttttaaaaaccttccaaagaaccagctttttgtttaattgattttttatttccaatatcattcattttgcttttatctttatttcctttcttacgcttttttgggtttatttagctcttctttttctagtttcttgaggtaataacttattgatttgaaacctcttcttgtttctactataaatttttaatgctataaattttcctgtcagcactgctttagctacattccacatattttgattttatattttcattttcattcaattctgtgtatttttaaatgttcctttgagacttcctgtttgtcatatggattatttgcaagtatgttgattaattttcatatgtttagagattatcctattgtctttctgtcattgacttttagttggattccattatggtcagagaacacaatctatgatttcaattttaaaacatttgctgaggtttgttttcaggcccaagatatggcctttcttgatggattttccattggtgcttaaaaaaaggtatattctgctgttgttgggtggggtgttctatttatgtcaattaaattgttagttaattttgctgttcaaaataaccttgctgattttccttctagtagttttatcagttgatgagtgcagcatgttgaagtccccatctataattgtggacttgtctgtgtctcctttcaaatctgtcaggttttgcttcgtgtattttgaggctctgttatttggtacatgcacatttagaattattatgttttcctagtagattgacccttttatcactgtgtaatattcttgtttgtctctaataattttctttgctctgaaatctactttagcagatgttgatttagctaattcagctttttaaaatgtttacatgatataattttttttatccttttacttttagcttacttaatgttgaatttggaccaagttcttgtagacagcctatagtttgttcatcttttttgtatgcatgctgccaattttagtcttttaatgagtatgtttagaccatttacatttaaggtaattattaatatgttagagcttaactctgcccttttattactctctctatatatatctgtatctatctatatatatatatatgatcatatatatgtctctctcccccctctctttatatatttgtgtatgtatacatatattacttgttacagacagtcaccctgtttaggtttagcatgaaatcctgccacattttgtgggctgtgatttcaatgatgtttaagtcccagagtctttgtgatgttattttgatctgtgaagtttatctgataccactggggctcccatggttccctcttggtactgccagaggaggcagaagggttttgcccaggctggaccacctctgggtgaaaagggagtctcaggcctttgaggccaaagatgcatctcaggagagacgcttttgaaggaatccctcttgccagtgccatctggccccctaacccagtctccctttgtgggacaagagaatctcagaccttgtgggagaaggagattgcttcccctggctgcttattagcaagcttcccagtcataaactctcttgcctttggcttgtcagctttacctggtgttgttgaaagtattcctgttcaatcctggggaggaatgagcctacctggactgccttctgtaccaaattgggggttgggtcatgctgagactggctgtctttcttctgtagagtagagggcacatatagtcctgaaatcccaaattagtttgctgtcctcttactaccgtaccttccaaagttttcttttggctgtctcttgcagtatttcttgggtttatagttgtatatacaggcgaagaacaagagaaatcagtctaagctagcttgtcaggactgaaagtctcaatcatgttttaaaatattttattaattttaatttgagggtaactttttccaacgctgcctttttttttgaggataactcaacaacaagaaatacatgtatataactatttttaaaatgaatcaaaattggctcactaaaattttgtttcttgaatgggtaaactttagttacttgaactttttcttaagtggaacatattaacaggaaagcaatagtcaaatgttgaggcattaaagtatatacaatgaatgtgttctgtgtgtgtgtgtgtccccattcctcatattctccattttttgtgctttctctgctctaatggcttttttcctcactctggcttgccttttcactctcttaatggtatcttttgatgaagagaagttcttaattttagtgtagttcaacttgttgttaaaaatgattaatactttctgaattctgcttagaaatatctggcaagcccaaggtaatgaagatactctttgttttcttctaacagctttattgctttgactttcacatttagatacacagtctatctggaattgggcatttttatttattatgtgagggctcaagattcattttttccccatatggatttttagttcattcagctctatttattgaaaagacatcctttgctcaccacatttgcagtattgcctttcttataaatcaggtctctatatgtggaactctttctggactcactataccagtggcaactggtccaactctttctgaaccactatagtgttcagtagaaatataatgcaagccgcaaatgtgagccatatgtgtaactttaaattttctaatgaccatatcttaaaaagtaaaaagaaatttatgaattttatttaataacatgttttattgagccctacctgtgaaaatattaacatgtaatcaataggaaattattaatgagatattttacatgttttggtactatgtctttgaaattgggcataaatttaacatgtgtggcacgtctcaagttagactctaaattttcaccagaaatacttgatctgtatttaggtttcatacaatcacagttgaataagtaggttcatatgcctaaatttgtccaaatcatacttcagagttttccagtaactgaatcacttatcagttcttgaatttaaattaattaaaaatttaaacattacaaattcagttccttaattacactagctacattttaggtgctcagcactcacatgtgtcttgtggctcttatattggacagtgcagctctattctattctattgtcagtctttactgtagaacatacttttgtaattactgtcactttatcataaatcagagtggtagtataagtcctccaactttgtttttggctattgcctcagctattgctaatcatttaaattttcatataaattttggaatcaccttgtcaatgtccactagcattttttcatcacagtttactactgtttacattgttagctgcatacgtgacaacaagaaatccaaagtgatattgagctattgttaccagtggagggtgcccaggctcttggcattttgaacaaagaattggacaaaatgcacaaagcaatggaagaatgaagcaacgaaagcatgtagttattgaaatgaaagtacactccacagggtgggagtgggctccaggaggtggctcaggagcccctgttacagaattttctggagtttaaataccctctagaggtttcccattggtaacttggtttacactctatgtaaatgaagtagtggcccacaatcagtctgattgcttgtgaaggtgaccaatcagaggctgaagtgaagttacatagttacaccctatgcaaacgtgtgattggttgcggaaagtgaccagtcagaggctgaagtgaagttacaaagctgtactcctatgcaaatgaagactgggcccgtgaccagtttggttgcaggaaaagaccagtcagaggtactttcatttttcatctgcaactgcagaaaaagtaggggtattacaaagggagtagcctctgatccctttgttacttggatgtggagaggtagggtgttccttttaattcagttctgggaagtcagcatgaattggccttaggttccctgcctccagaccctattctcctgcctcaccataaaggctggatagttgacttggttcttttcctaactaaacaactggttctgaaacagtggccttagtgtttcagaaacactaagtgaaacacttagtgaaacactgccattcctttatctgcacctctgcaaataagcttttccagataattctgaatatcagttattcaggccacaaatgcaaaccacagggtaggattttaacatataatatagaagtaaggggaaaaaaagtgaataaatacatttctttttttcttcttattttatcagagtggagtctatgaaggtgttaggaccagggaagaggttggagtagctgctgattttggaaattacatacagctctatcatttctagtacttagcacaaggcctggcacatactaggtattcaaatttttggcaaataaatggaagcattatacttaacagaactcattgatcagatatggagccattgttcttgtagttcatgagtgaggccctctattactgtaaactgagactttttggctgaaatgtctgagtaatattatacaaagtcatatatggcatttggctttgtgactttttttagaatatgaaaagaggtgtttggggacataattacaatagaattgctgtttaatttggtataactcatgatgcatgatatatgactggaaagtgagttgttctgatttaaatagaacactattgaagtaaatcatctcatgtttttaaaatagttctcaaattgtgttcgtactagatcagttatctggctgattgttctaatagaagtatctctacatttaaatgtctttgatttcttcatcaaccaaatgaactgacttactaaattcttgttctaaaggaattttcctgttggaatagactatcctaaagtaacttctacaacagttgttttaagctaggacatgttcaaaagcttcatatgacttatggcattaggttgaacagtcaagaaaacattaattggtttatttttctgataatatggctcactgaatcagttataaaacatttaaaacatatttgatttaaaaaggcatgacaacaaagggtcattttaaatgaatagataactacaaaaatgaatgagcaggagactagggaagctagcgagctttgaaaccactggataacctggggacatacacagacctagtaggtaacctggaaacttggagtaaaaaggggctggggcctgggcgatggagtgagacttcatctctacaaaaaaataaaaaagcattaacctggcatggtggtgtatgcctatagtgctagctactcaggagactgaagctggatcattgcttgagcccaagagttcgaagttacggtgagctatgttcatgccactgtgctacagcctgggtaacagatacttgccttcactatttctattttatattagacattaatatataacttatttgtaagttatttaaaatatatcttcagttggaaattgtagccagtgtaatgacacagggcagagagatgaaaggtataagagttggaaaggaagaaacaaagtggtattatttgtagatgatactattgtctatgtagaaaagtccaaggagtctacagaaaaatcaatagtttagcatagatgttggatataaggtaatgattaaaaataaatagtatttaagtaaacctaaaaccaaaatctattttaaaaaagacaatatttataatttcacaaaagtatatcaagatgtaagtgtgaacagacatgtaagatcttttcagagaaggtaataagattttattgagtgaaaattaaaaatcttaaatggagagaaaaaatattttcagatagggcgactgaatatcataattatgtcatttattcacaaaatgatttgtaaattcatgcaatttcatgcaaaaattcctgtggtttttaaaaatgaaatttggaaacttattttaaaatttgcagaggttaaattatcctggaaacttggagaagaacaagttagggagcaggcacttgatctacactatgtagtattatattactgatgtcaataatttataattttatggaatggtagcttcacagagatagataaatagactagtgaagcagaatataggcacagaagcagacctttatggaaacttaatgtatgtcagagtgacactgcaagtttgtggaaaaagaataaactgttcactatatattgctgggacaattggttatctacatgggaaataatgaagtggaatctctacttcccaccctatataaaaatccatttcaggcaaattaaaggcttaataaaaatagccaacacttatgttgtacatatcatattattgaccttgttctagcactttatatacatttactctttttatcatgttagttaccttcattttttaaaataaggaaactgaggcaagcacagagaagtcaagtaatttgcctagggtcacagtagcagagccacattttaaccaggtagtttggctccagtgtctatgcttttaaccactatgctatactttttcacttaaatgtgcggaacgaaactaaaattttcaatataagggcatttgtttatgaccgtaggatagggaagggttgtttttaaatttttgttattttttttttaaataattgggtctttatatgtttccgagacaggactgaaactccctgccttcaagtcattttcctaagtagctgggactataggctgtttctttttttaaaggaaggattttatgtttatcatgaaggaaaaaaataaatttggctaacttaaagagttatttatcaggagacactattaaaaaaaggcaaatcagaaatttggagaagatatttttaatactgataataagacagaattgtaccctgtaaccataaatatgtagaatttctaccatatcaataaggtataagtttctgttgctccacatcctcttgcacggttggtattttagacttttaaaattcttctgccaagcacggtgcctcatgcctgtaatcctagcattttgggaggccaaggcagatcacttgaggccaggagttcaagaccagcctagggaatatagtgagactccatttctacaaataataataataaataaacattattattgttattattctgatcctggtggtcatagaatggtatatgtatggttttaatttgcatcccttgatttttaatgagggtaagcataatttcctctattaatggccatttgtgatattttcttcagtgaagaacctgtgggagatggaacatgaggctgacagttggcattatgttgagcttgtgagaggtgatgtgattctaccttcaggtactactgggtctgtgcattctataaaaccagagaggcaactatgatcagatctcctgctctggctgattttttatttctaggagatttttcatttgtttgttttcatttagagctgtactcctgagtcattaaatagaacactataaatttgctggtgcaggtcataacatttgaagggattaacatttggtttattctctctaaatccatagctattaggaaataacctaaaacttcaggatttactttgcagaaatgatttccttctaatgtatgctctctcaaaggaatttagaatcctgttacataagaggctatacagctttaatcccattcattgatatttagtgaccagttaaacttcaaaacaatttttaaaaatttccctaatttaaaaagtaataataattatgtgaaaaaattttggaaaatacaaactcatagataataataaaccatttagagaactgtgacttaacacggtatattcttttgtcttttttttgtaacctttgcgtacgtagttgagaataacagccccattttaaaagaggagctttaaattcttattatgccccgttaaaaaccccacaggtaatcataattatttagaaatttaatcacacagatgttgagtcacaatttgtgatttaatttgattacttatgtattttcttatttttattcttatctctttcctggatgtgattttttaaaaagttgtggccactttaaagtcttttgagagatgaaatgggagcatgtgcctgttaccaattaattgcctctcagctccaaattcatccttcattgccctgatttgtgatattagagctgtaccctggtagctgtactatgctacccagaagataccagattatcttctgaccacaaatgcataaatgaacctagccaaaaccaaaagaaccacttgctgaatctagtacaaattgtcaacatgagctaaatggtgtttgctgtttgccactacatttgagggttgtgagttaatcattaaaagcacactgataggccaggcaaggtggctcatgcctgtaatctcaacactttgggaggctgaggtgggaggatggcttgagcccaggagtttcagatcagcctggacaacatagcgagaccttatttccaccaccaccaccacacacacacacaaaaagcgtactagttatactgctctattttcagtgcttagaacaacaccttttacttagtaagcattccctaaataatttgtgaataaaacaaatcaggtcagcccaaattcaagggatggaacaagaccattcagtttttacagctgctctctttattgagagaatctcctctgtcctctgtgcctctctatgttttataacacactgtattataacactggttaatgttgaattgtgattaaaaatttatctcctaagtaaggtgtttgaagacaaggatcagtttcttatttatcttttgctgttcaacaaatatttattgtatgcctactgtttcagtcactgtgctgaagtaaacagaacagataaggaaggttcttgcattcatgaaacttactgcaagtgcagtatttttaatcatactgctttttagcaagtttagtatcattctgctttttagcaaggccttgttttttcattttggccccaaaccattttttatccatgagccttttaatgttatattcttgcaaaatttttatctttagtcatcacttttgatttttatagttacatatttagttgttatgcaatatgtatgttttacataccaagtatgtttaagttaatatactattttccttagtagttaactcttttcttggttattcacttttgtcccccgttagcagtatgtcttacgtattttaagattcagagttgaaattctaaattccttttactcacgggaaattagattttagtgttttgcacaatgccaaatacatagtggacacttaataagcgttcgtttgtagtaatagcctctttggttttctatttcatagaatttcaccaaagatgattatttttgactgacttttaaatggctacatgaattcttgaccctcagcctaagtaaattttttcattgtggatcacaatacctactttctcttttccttcttcattttactcttaaaaatattaatgtgcaaatttggaagtgtcagtttcacaattgctaacctacttgaagtgttttgaaaaatgaaattaaggaaaatttagagaagtggtttattaccttaaaataattaatagcaagattcttcttaatatgttatgtcatagtcacatcatttatttatttactgattcattcttggttcagccagtcatccatttaataaatgtgtttcagtccttatcatatgtgcaaggtgctagtattatgaagaggaattcaacacagctgatatgtggagggatgtctttaatttatatttaaatctctgtgtgagatttgaaatattacaaaagactagagtataaatcaggtggaaaaagggacagcaaagaactgcaaggaacttaaccttttctagcatccagcttgaccattctataaaatatatttagcaaataatattctgatattttgatttgaaagcatgaggctgtagctctttcataaatgaaagatttttaaaggtacttatagcatctgcttattactctaaatctttgtgtcatatattgttgcagtgagtttgtgaggattgaattcagtatttagaaataatgattattgaaaaacatgaatacaaacatgtgcatcttaggaaagttatgtcagatgaattagttaatacctgaatagttcaaaatgatgaataattgttagaattataacatattataaattatcttaactacagatatagggatgttataatttgataattcagaacagggctgaataacaatcattctcccattaatttacaattaatctctctttacaattccagtgtgttttgtaagaaataattttccatgagtgaaataatgtaattgccttctctctctctctatatatatattttgtatatagatgaccagattaagacatgaaaacattagtgagataaaaaccaaagatttctctaatgggcagtttgtttgtaagaatgatggagatgatacagagtagctcatatatttacatgcctaagtgaattttattctgtgtttttatttaaatgtgaataataaatgaatccgtagatcagcaaggaggtttaaagtattcaaaaagcaaaagttaggacatttggggtttaatttttttcatttaattaaaatggaaaggatattatttaaccattgagctgggtaatgttaatagttcatggaggatgcaaaatgattcttttttctcttttggtgctcctttaatgaataaacatcatttttttttaatactgtcaaagcactttggagaatggaattgtagctgcacaacttatattaaagtgaagttactcttacaattctgttattctgttttctttttttccaaattttaaagacagtcttttttttttttttttttttgagacggagtctcactctgttgcccaggctggagtgcagtggcactgatctcggctcactgcaacctctgcctcccaggttcaggcaattctcctgcctccacctccagagtagctgggactacaggcgtgtgccaccacgtccagctaattttttgtatttttagtagagacagggtttcaccgtgttagccaggatggtctctatctcctgagcttgtgatccgcctgccttggcctcccaaagtgctgggattacaggcatgagccaccgcacccggcctggaaaatattttttatctccctttatttctttgattatctgccccactcccatgcttagcctagtttttacatacttttatttaatattaatattttataagttttaatatttattttcagtcttttctttccccttccccctccaaaacaggcttggaactaaactcatctttatctattaatgttaaatgagaatagtaaagttggaattagagcaagtacatgttatttttaaactgattactaattcagtaattcataactaattaaatgtctttatttttctagacccttactctcctccttttttctttcttgcccatctcattatcttataagtaatttgtgtttttaagtttttttctccctagataatagaaagggaaagaaggtagaacataaataaggattacttaataatttttcattcagttatttagctgtgtttcccactggcaaaaatatttctctactatctttgtatatattgaataatacattatttttaaactatatatatcagttactcttatcagtccaaaagcttatagaattaatgctcctcctccttttccttttccccttcctcctcgtcttcctccttctccttctttcttcttcctttcctcttcttcttcttcatttttctttcttcttccttctttcttcttcttccttcttctttcttcttttcttcttcttcttcttcttcttcttcttcttcttcttcttcttcttcttcttcttcctcttcttcttcttctccttctccttctccttctccttctccttctccttctccttctcctccttctccttctccttctccttctccttcttcttttcttttttgaatatatagagacagggatctctctatgttgcgcaggctggtctggaactcctgtgctcaagtgaccctctcacctgagcctcctgagtagctggaactacaggcatgagccactgtgcctggctctgcaagactgatgtagcaatctttttgtttgaggctggggtgacaaggttgttgctatgttgcccaggctggcctccaatttatgggcttaagcaacaagcccccttctcttatcactccccattactagctccaactgttcctatttacttatagtcctgaaatacagtagtccccctgtatcctgaggggatatgttccaagacccccattggatgcctgaaactgggcataatactgaattcgattgctggcaatcagaacacgtttctgttcacatcttctacccataaatttaatgccttttccatcttaactaagcacttatcacatactatggctgtaacttttgcagtttgaggtgctatattagtccattttgtgttgctataaacgaatacctgaggctgggtaatttataaaggaaagaggctttatttggttcacagttaggcaggctgtacagcaagcatggtaccagcacctgcttctggtgaggacctcaggaaactttcagttatggtggaaggcaaagggggagcaggtgtgttgcctggtgagagagagatcaagagttgccagcctctttaaggcaactagctcttacgtaaactaatacagtgagaattcacttgttactcatcacctcccactaggttccacctcccacattgagggtcacatttcaacatgaaatttggaggggacaaacatctaaactctatcaggtgcagtagcagaattagtacaaatatctttttccttcttcacaatctcacagatagaatattcattgttactgtaggtcttggcagcctcagcattcaatttctttttcccttgttaagttgagaacttttaccttttcacttaagaggaagtgctttatggcttccctttggcatatccaaattgccagcatcactattcttgagctttggggccattattaaataaaatgaggattacttgaacacaggcactgtgataccgtgacagtttatctgataagagagcaagctaataagtaactaatgagtgaggagcatatacagcatggacatgccagacaaagggataattcacatcctgggtgggatagagtggaacagcacgagattgctactctgagcagtgtgcaagttaaaatttatgcattatttctagaattttccatttaatatttttggaccaatattgacttcaggataacaaactggtaagcgaaatcatggataagcagggactactgtatttccagatttcttttccctctgtgcctttgcacatactgtttcctctactgagagcatatttctgctattgcccttccctttcttatcacctggcaagctctttttagcctgctcagaggttatttcctgaagccagtttattacacttcctccttttctgtattcctcctatagcatctgatgtatgcctttaagatgactatactgtagtgttttatcacctcccttgactttgagctccgtgagaacataaatggattatttcacctctcttcatgatttggacagaacactcaattgttagactggaaaggagaaaggaaactaaagtttgagtgtctcttatgtgccagggaatgtgcttaattgtgttgttttagacacaatggaataaattcaattgccacaataaattttgtaagaacatactatcataattagtatatatttttattacatattatctccatcttatagttcagaaaactgaaattaattaatttccccagttattaaatactagagccaggactcgaaccaaggcctgttttgactctacggtctccggttatttcattttactgtgctgtttctttactactagtgtaattgatgatatgatcttgtgtaatgtaaagaacatggacttggacatcatacagacctggatttgagttctagtttaccatttaactaatgttgacaagtgtcttaatcgctataaatctctgtttcccccctttaaaaaatgtggttgttatcattatttactttagaggattattgtgagaattaaatgaaataatgtattagagggttttgtgcagtgctgggcacatgatagatgctttataagatgctagttgtatcttatctgatcaacagataagttgatcaacaggtagttgatcttatcatagctacaagcaacagaaaaacttacagtggcttacagtggcttagcaaaaaaacttttaaatggcttcacataataaaaagtttggagatagtcttcaatgacttaagtttctttctttctttctcatagtcttaggatatctgtgaagttgcaggtgttacatttaaagcagaaaaaggaatggtatcatctgtgtctatatcttttattagaagagaaaaaaccctttccagatgtttcctttgtatctcactggctggaattggttacatggactactgtaatagcttagctgctctcctaactccagtcttgccattatctaagctgtgaaaaacactggaaaagtggagaacaagttgattgtgattagatcaacaattattcttctactagggatgagcacattgctccctcatataaagttacagaagtgtcttgtacagttctggtggtggtggtgatgatgatgctatgtgatgacatagcactgaaaaccattgcaaggtatgcttatcatttcattagtctgaagcagttaataagtaagcattgtgcattgttttaatccatatcacataaagactaagagtagctcagctatgtccttatatttaagtgctaacattttacaaaattggctttacaggcattttcttatctcattagcttaagaatgcttaaaaaaatgctgcttctgttacttctgattgttcctaccctcctgacacacacatcaaacaacaaaaccaagtggacaaccgccactaccagatatataacaaagaaaccccttaacattgctggagtccctctgatagttttttgtctcctgctctttttggagatctatagcttcaatgtcaacttccggaagatgatagtattcttaaggccactttttctacccctaatatctcatgttgggatttcccctttcactcttaccagactcagtgaaaacaaagggatctgctatagttctgccttctacccctcagcttcctattattggagccttccacaattattagatctccttctgccttctcaccctgttgattttgggctgactgggagagaagaggaaaactgaactgtgaagctcttgctgcgttgccagtgattgggaggatatgttacccaatgctcgcttgggttctgggatgaattttgccatagaaactggtataatggatgtttgggttgtgtactattattgcttctctagttcaactacattttggcttttgaggactggcctgagatctataaaataccactatatatgattcctttagggaaatactttgactgccaaccaatttgaaaacaaacattcagagtagaatatattaaatcatgagttgaatgacctatgtttgggtttttaccattctgtaccttgataggatgctagagtaatacacactcatccccagtaaaaaggcagaagctaaggacatggataattagttgcctgattagtccctctataataaaaaagttaagaacatggaagattcgtcttggttgcagaatgaagtatgttctttcctatgagtacttcatatgtattaattttctttttaatatttacatgttgaagcagttatttttccattaggtctttactcagagagcttagagatctatatgtgtagagaattaacatctgattattgcatgatttcattctttggcttaactaaattgttttacaaatcgaataattgtttacttttgtattttaaaaattttcttccagtgttttctcaagcaaatcaatgttaatgccagattttctagatccttagatttactagatggtttttagtcattcagaagccacttataatttagtagagtaataaacataataatgattatcaggttcagcttccaaatatttgagagagagcatatatatactttactgtgacaacttttagaaactgttttgagatagatgaagaaaaggcagaagatatgttgagaagcagatgttgtatgacggaagtacccagctgtgcactaacaaaatgaatctcatgccgattagttaacaattctttggcagtcagagacatatgtaaagcagtgaacacagcatggggaaataaaaaaaaattaaaagcattttctaagcctaaaacattggcagtatctagtctaccatatgtgttactgaagaattggttttattgtggataagtcataccaaggtcacttgcaaaaaaaattggttaacccattagagtcttcattctcaaaaatatatatgtgtatatatatatgatcattatgtatttcatatatatataacgtacaggcatattatatgtcatgtatacaatgatcgtatatataatgatcatagcagtgagtttatatatgtattatatatcatacatatatatatataaaactcctgggctcaagggatcctcccacctcagcctctcgagttgctgggattacaagctactgtaactggctccatagccttagtttagattcttcatcatccttatcttgactattatgttagcctcacagctgctagttttgtctgatacagtagatagtttagattgtttaatgatttcttcataacatatatgttaaagtataagatcctcaaaatttataatttgccctcagtttatattagctgggcatttccatcttgtattatattgtaaattctttgagtggagcctaacatctttttattcatcactatgttgtggacatagtaactactcagctaatagttgttgacttaatgagatagacctaggcagattcttggcttagcaattcagtatgccttgctcaaattaaaacgaattattctgttagtaggaataataacattattttaatatattaataattcacacataattttacagtagtaatttatacagcccgctggttctgttaatttgaattagtaagatgttaagctattatgtgcaatggttctgagttccagtagttctgattagagttgaaaatttttaatgcacagaatatagtaatgtctaccttcttgaagactagcaggaagctttgttttggttagaattactttctttttcctagaagggaattaatggaattgagtaataacaagagcatacactaggttttggatatttattgtggtacagagtaaaaattagcagacgactcctcattagaagttttactcttgatcagaagtttataaagcttattttaaaagtttataatctttaccttgtataaataagtctttaaccaagatcatttatgatgcttagaatgtaccaatgattcgttacttaccctaatggaatattgtgagtaactggtacaatcccatccgtagtttttgttttagtttgcaacttttctttttaaagtcccttttaacctaaagtttgattaatacattgaaatgtgataaaaattgttggttacctgttgtgacattgtttttaagaaaagtgtttatatcatgaaaacaagtttcttacagacagactatatgttttatatatttattcattttgtaaaaattgaggtataatttacatatggtaaaatttacccttttatagtatgcatttcagtggtttttagtgtattcacaaagttatgcaactatcagaagaggattttggtaagacggagtgggaagcatcagaaggtcttacctcacctagacaacaactgcactggcagaatctgtctgatataactattttggatctctggagtctactgaaggctttcactttccagggagaagatttggatctaattgtggttatttttggtcagttacagctcttcgcatggtagcagctacccatccactaccccagccccatggcaggcagttgtgccaacaggtgttccagaaacagttttcacacagctcatgggagctagagtgggcaaaaagcaccttgtcctccaaatattggggatctgtgctctgattgctatttctgctcacagaggtgcagagagaggatggcagcctttgttgtatacctacccccattgttgcagtcccctcccccttcagctgaagtgattccaggggatttaaagggttagcacctttacctcctcatttttctctttttgggagcagacatgaaaggctagaatattcaaaaacaatggcatatgtgaggaaaaattagaaagtgactgtgcatgcccagggaaaggcacaggtttggaaaagacctgggaaaaccttaagtttacatttcaggctgatcattggcacaaagacaataccaatcaagacaaaaacaataaatagaaataacaacaaaacccagcaaaccctgaggaaagaggagaatctgatttccagagtaaccatattattagattctagttttcaacataaaaatgacaaggcatacaaagaaacagaaaagtatggctcattccaaggaaaaaactgaatcaacagaaactcttcctgaaaaagacctcatgtcaaatctacttgacaaagactttgaacaactgtcttaaagatgcttagggaactaaaggaagacgtggggaaagtcaagaacataatgtatgaacaaagtggaaatctcaataaacagaaaacctaaaaagaaaccaaaaagaaattctggagctagaaaatacaataattaaaatgaaaaatccattagcagaatttaaaggcatatttgagcaggcagaagaatgaatcagcaaacttgaagagagaataatggaaattattgagtctgaggaacagaaagaaaaaatactgaagaaaaataaacagagcttaaggaatctgtgtgacactaccaagtggaccaacataaacattgttggagtcccagaaggagaagagggagagaaaggggaagagggaatatttgaaggcttaatgctgaaaacttttcaaagctggtgaaatacatgaatataaacatccaaaaagttcaatgaactccaagtagtgtgaacccaaagagacccacaccaaggcacataatcatactttgacagccaggtgtggtggtttgtgcctacagtcccagctactcaggaggctgaggtgagaggatcatttgaggccaggaattcaaggtcagcctgggcaacatagtgagaacccacctctctaaaaaataataataaaaaaaatgagtcaggtgtgttggcatgcacctgtagtcccagttactcaggatacttgggaggctgagatgagagattgcttgagcctaggagtttgctgtgattatgccaccacactccagcctaggcaacagagcaagaccctatctcttaaaaaatcatatttttgaatgacagagaatcttgaaagcagtgagagaagcaacttatcacataccagggatccttaatattattattggcagatttctcatcagaaactttggaggccaaaaggctgtcggctggcatattcaaagtactaaaagaaataaactatcagccaataattctatgtctggcaaaactgtcctaccaaagtgagggataaattaagacattctcagataaacaaaagatgagggatttcattaccactggatctgtcctgcaagaagtgcttaagggagtactgcagagtgtaatgaaagaagactagacagtaactcacagctgtatgaaaaaataaagatctcaataaaggtatatacatgggtaattatgaaagcaagtattattgtaacaacagtttgtaaccccactttttttgttttcttcatgatttaagagtaatacattaagaaaaacaatcattagtccaaaagctagtattattgtcactttggtttgtaactccacattttttttctacataatttaagaaactatcacatttaaaataattattagtttttgtttttggccacacagtgtctaaagatataattttgtgacatcaacagccaaaaggggaggaaatggagctgttatgggagcagagttttagtatgttgttgaagttaagctggtaataatttaaattagaatgttttaactttagcatgttaaatgtaatccccatagtaaccacaaagaaaatagctatagaatatacacaaaaggaaataaggaaggaatttaaacattttactacaacaaagtcagtgaaatacaaagaaggcagtaatgcaggaaatgatggacaaaaatgtataaagcatatagaaaacaaatagcaaaatgacagaagtatatatcaataaatgctttaaacttaaatgcgttaaactcttcaaccaaaagacagagattggcagaatggattagaaaaacatgattcacttatatcctgtctacaggaggctcactttagatccagagacacaaatagattgaaagtgaaaggattgaaaaagatactccatgcaatagtaaccaaaagagagcaagagtggctatactgttatcagacaaaataggctttaaatcaaaatgttgtaagagacaaagaaggacattatatattaataaatggttcaatacagcaagaggacacaacaattaaaatctgacatatgccacaacatggatgaatcttcagaacattatgctgagataagtctgtcacagaaagacaaatactatatggttctacttatgcagtatagagtgtagtcaaaaatcatagagacaggaagtagtatggtggttgccaggggtgcagtggaggatagaatgcggaattagtatttaatgggtaaacagtttcattttggtgtaataaaaatgttttgaatagtgatgatggttgcatgatggtgtgaatgtatttagtactactgaactgtacacttaaaaatgattaatatgttaactttatgttatgtgtattttacaactatgacagtctattttgtgctgctgtaacagaaaacctgagattaggtcatttataatgaatggaaatatatttctcacagttttagaactgggaagtccaagtcagggactggcatctggcaagggccttcttgctgcattgtcccatggcaaaagggcaaagagaggtcaagggaaaggaaaggggatcaaattcattttttatgagaaacctacttctgagacagtagcattaaatcattcataagggcacagccctcatgggctaatcacctcttaaaggtatcacctcttaatacaattacaatgggaattaaacttcaacgtaactttgggaggggataaatattaaaaacatagcaatcacaataaaactgggaaattaaaaaaaaattgtgcggctgggagcggtggctcacgcctataatcccagcactttgggaggctgaggcaggtggatcacctgaggtcaggagttggagaccaacctggccaaaattgtgaaatcctgtctctactaaaaatacaaaaattagccatgcatggtggcatgtgcctgtaattccagctacttgggaggcagagacaggaaaattgcttgaatctgggaggcggacgttgcagtagagccgagatcacgccactgcactccagcctgggtgacagaacaagactgtgtctcaaaaaaaaaaaattgtgcaactatcatcaatatataattccagaacatttttatcaccccaaaggaaacccatattcattagcagttacttttctgcttagcccctggcaaccactaaatgactaaaaataaaagctgaagctatgataggaatgtcttattctaattttggtaatattcattatattttaagtagacagatgtaaataatgggcaaataatgcttttaattattttctttaacccgtcttagagccaagaagcttctttcaaggcagtggtacatggtggaggctatcagagtttctagaataattatctaggctgaaagtcatatctgggctttttggtgatctttctatgtgagcacgtacagctaatttgactaattctcttcaaatatttcttgaagatgtatgttacaacaaggcttaggttataatattagaataggccttctcttttgagtggagtaatatgattattctaataaagatcctttcttcactgaggctactgtttgggagttgaagtaactgggaaatttgaacctacccttctcctttcacattatatcaccagtataagagcagaattgtcagatattccgttaaatattggatacgaaatgttttttaattgataaataatttgtgtgtggcagtatttctgcattcttgtcctataaactaatatcagagttctttggttgctgtgacatgcctcctcagattaatagtgagatttcttcctgtaggtaaccctaatttcttttaaagcaatgatttatggtattatgatctaaatgccttttttttttaagagatgggatctcaccatgttgcccaggctgagctcaagctatcctcccacctcaccttggcttcccaaagtgctgggattacaggcatgagccaccatacccggccctcgatgcatttttaatgttacattagttgctaaaaaataaaacataaaaaagaggccgggcacagtggatcacgcctgtaattccagcactttgagaggcgaggtgggcagatcacctgaggtcgggagttcaagagcagcctgaccaacatagagaaaccccatctctactaaaaatacaaaattagcccagcgtggtggtgcatgcctgtaatcccagctacctgagaggctgaggcagggaaattgcttgaacctgggaggcagaggttgtggtgagccgagatcacgctattgcactcccctgggcaacaagagcaaaacttcatttcaaaaaaaaaaaaaaaagaatattttgcaatatcagggggcaataatgtgatatgctggatagtaaaaagttaatgaggacatagatgcctagtctaagcaaaatagataagaagttgctgatcgtaattgatgagaatgacgtcacagtggaatagcagataatgcatgagtggtgaatttcctcgtttagtcttactttgaggcagcaaataaatcctttataagtgttgcattacttttatggtgtgtgtgtgtgtgtgtgtgtgtgtgtgacagagagagaggcttcaatccttaaatcatgtaatattaagaaaaaacaaatgaattcacttagaagatttggggctggatctatattttttcatcattttaacatttgggggttaaaatttccagaccgttggagacgacatccatccagaacagagtagatcctggagattctggataaattatctgcaagtgcatttttttttcccaatagattgagtttattatcaacattcagtttgctgattaaaaaatttttcagtatatcgatattgaactcgagttggaagaggcgagtctggtctcaaaatggagggccatgatccaaaggaaccagagaagttgagaaaactgtttattggtggtctgagctttgaaactacagatgatagtttaagagaacattttgagaaatggggcacactcacagattgtgtggtaatgagagacccccaaacaaaacgttccaggggctttggttttgtgacttattcttgtgttgaagaggtggatgcagcaatgtgtgcttgaccacacaaggttgatgggcgtgtagtggaaccaaagacagctgtttctagagaggattctgtaaagcctggtgcccatctaacagtgaagaaaatttttgttggtggtattaaagaagatacagaagaatataatttgagagacttctttgaaaagtatggcaaaattgaaaccatagaagttacggaagacaggcagagtgggaaaaagaggatttgcttttgtaacttttgatgagcatgatacagttgataaaattgttgttcagaaataccacactattaatgggcataattgtgaagtgaaaaaggccctttctaaacaagagatgcagtctgctggatcacagagaggtcgtggaggtggatctggcaattttatgggtcgcggaggaaactttggaggtggtggaggagctatggtggtggaggtggtggcagcagaggtagttatggaggaggtgatggtggatataatggatttggaggtgatggtggcaactatggtgtggtcctggttatagtagtagagggggctatggtggtggtggaccaggatatggaaaccaaggtggtggatatggtggaggtggtggaggatatgatggttacaatgaaggaggaaattttggcggtggtaactatggtggtggtgggaactataatgattttggaaattatagtggacaacagcaatcaaattatggacccgtgaaaggggacagttctggtggaagaagctcgggcagtccctatggtggtggttatggatctggtggtggaagtggtggatatggtagcagaaggttcgaaaaacagcagaaaagggctacagttcttagtaggagagagagcgaggagttgtcaggaaaactgcagcttactttgagacagtcctcccaaatgcattagaggaactgtaaaaatctgccacagaaggaacgatgatccatagtcagaaaagttattgcagcttaaacaggaaacccttcttgttcaggactgtcatagccacagtttgcaaaaagtgcagttattgattaatgcaatgtagtgtcaattagatgtacattcctgaggtcttttatctgttgtagctttgtctttttctttttcttttcattacatcaagtatattgccctgtaaattgtggtagtggtaccaggaatgaaaaataaaggaatttttaacttttcaaaagaaaaatttttcagtatatctgcataaatgaaattggtccatcatgtgtattagaggaagctatccttactccgtttgttatcaggattatgttagcttgaagaatggactgataaactttctataaggcttattacaggctttaacctgtaaaattgatctcatcgtaaacagctttgagagtatacagatagttgactatttttcttctctggtttcttcagatactcttcatcatcttggatttgttttaataatttatatatgttaaagaaaataatcaaaactgtgcagatttataaatctttaaaattgtacacaatattatatattttaaaactccctacatatgcagttttatcacccttctcatttatggtacaccataagactcactttttgatgccaagtgttctcgaaaatgtcctaaggaagatcattgctggaacaatgttatttttgagacttttgttccttataaggaaatagacatcaattaaggagggaattttttttttggaggtggaaatgggtagtatgatcaagcaactatatgtatatttccctggggaacacggcattaagaagagaaaataatcccaactattaacaatttcatctgtgcagtggtttttattctgcaacattgtcttttctatttttgtacatgttttctagaaaaggtaaacatgtagtagaaataaatgtgatgttaattgctatggcagtgtgtctgtacacattacttttttctcctgtctacccaccttccattggcaatcacccaactggttaggtaaatgagggtggatggataataaacgtttcttcacaattacttccttagctctcaaaagggattctgaagcattccattataagtgctgcttacagacatgctgaaatgaccactttttgctctggagtgatattctttgcttaataaagaacaagagatcacaatatctttctttcctgagcagaagcagggcaaactgttgattcctttttgtttttttcctgcaaagaaaggaccttgcttatgtcacccaatttcccctttcaggaaggggaagtaatttttagtaagtcaaggtatgtagtagccataaggtcttctgtttaggattaaggttcagtgaagtcatttggcattcatttatttttggagttttgatccgaaagctgcttcattgcagaattttagtctgaattatgttctaaagattgatgatctctctatgggacttcactgtaactactccattaggacatcagatttagccaagtatttatgtgttaattttgttggattaacttatgtgcatagacatacacacacacacacacacacacacacacacacactgaagcctcattgttcccttaaattttaatttttatttgatatcttttcataatctattgagaaaagttatgatgggaatgcagtactgtgagtttgcactgacaataaaggttgatctatgacagcctcttagaagcaactactttaaaatattttatagtgggaaaaaaccccacaaatgcagttgttgttttgtatacttttttctctgttgacctgaataggattaaataacctctagggtgatttgcccattcagcaaagtggcacaggccaaaaaggagattaaagtaggatgagggggaaacaaggaaaacatgacaaaggaaaacccaagattagaaagactcagtgaagaaattttactcaaagaaataaagaggttttttcttccttcagtatccccaaagcaatatagcaggaaatcttactttgattatccatcaacaagcaagagtggaattaataagttgaccagcaaattgatacattccactgtgcacgcaaaagtcagacccttataagtaagcagttgcatgatatactttataagtatataagcacatatgttacaagttcttcatgggaaagcagaccagctcagcctagcctgaatgccacctagtgttctcttgtatgtataggatacaagtggagccaatggttgattaattgaaaatgacaattaagatagggaattacataaattgatataaattttcatgagcatttgatttttaacttaaagcatatactgactggagactgctgtcatctttcttgcataaacaacatataatgcttgtctcctgtttccaattcaaatttccataaagtagaacaagagcttagcaaactgagtatggaatcctactcgatttttatattttttataacaatttttcttttctaacattttgagatttacctttccaaagctttcagtgttttcccaaaacatttatctgttttcatagaaacaccctttttgtactcatatttcataatatttaattaaatattaaattgcataatcacaaattggcataaaagcagtgagaatgaacataacttggtaaaacagaatgtgaagacatactgctattggagtagtctgtttgatttagcttgcctgtgggcagctgcatgttttaaacaggaaatgtagagctagcccttacatagtggagatagcccatttggggagtttctgctctgtttgatttggctgatgcctgtattcttctttagggataattagctatgataggcctttatggctaagactttaaacaataatacttggtgaagtgagttgtcaaggagctaaatatacacattagtatgagaagagagcaacacgcaatctgatttcagagctggtgcacttaaccatcatgctatctactgcttccccttgtgggaagtattagcatgccactttatgtccataatatagcaagtagataagaaatggtgcataggaaataatataattatgctgacccttttctatattaaacattattctcaaaaaacagagcatatacctcagatatctctagaagagttaccaaaactgatcttctattaggttaacagtatgccactaaatgagtaagaacaggaattatgcaagccatttatgtagatgaaattcaaatagaattataaataacaaaactgaaaaagccatttggttgataattattatttgggatgcatattttgcttgttttaaattagttttcagggtcttcttcctttaggggtagcttagctcagtctttagcctgattcagttcaagagaagaaaggctaactactttttacccataagaggcagtgcagcttactctctggagtcaagctaacaagtatgacctgtccgtacattttaatttcacttagtagctgtgtgacctcgggcaaattaccttacctctcttgtctcagttacctcattataaaatagggattagtatctattacacagaatttcttttatttatttattttattatactttaagttctgggatacatgtgcagaatgtgcaggtttgttacataggtatatacatgtcatggtggtttgctgcacccatcaacccatctctacattaggtatttctcctaatgctatccctcccctagccccccatccctcgacaggccccggtgtatgatgttcccctccctgtctctatgtgttctcattgttcaactcccacttatgagtgagaacatgcggtatttggttttctgttcttgtattacacagaatttcaatgagaattaaatggattcatgtgaagttcttacaacagtgcctggtgtatagtaaatgctcagtaaatgatagtcatcatcatccttatcaaccttgaaaaagggaaatagtgatattattgttgaaaatatagccagaaacatgaatctgaagtatgtagtattggagattaggtacagaataaacaagaagtagaaccagagaaggcatacgtgaaaaattaatgtgtggtccagaatagatgtcatagttctgggcattacctcttgttcattaaaagataaatagtgggtcagggtagaaataaaaaaataagctggaggaaggaaataataaaaatgacatagaaatacagtaggataaattcgagagtggactttctgaaaaatcccaataatatatgagtacctacagcaaatctaattggaaaagaaaaagaacgggggaaatcatttaaaaagttaaaaagaggatcagggagagatcctaaatagtgtgagagactgctatgcagagttgtgtggtaatatatttggaaatcttgatgaaatctaaaatttcctagcagatataaaaatcagctagagaaatagaagactgtgattatgtcattcttctgcttgaaattcccctaaatagcttcccattgttctcaagataaagatagatactttcaacttgtcttccagtcctccctgatctgacctgtttcttgccatccaggccttgcattcttttcccttgggctcctgcactctggccatattgatcttctttctgttcatctaatactgttctcttttgcaccaggacctttgcacgtcctgtttgttttgtgtgttttgaacacttaatttctattaatccttagatttctactcaagtttcatgtcatggggaaactgaaccttactcttcacagactaggtttgggtccctgtgccatctgctctcatagctccttatactttgttttcatacttaacactattaacaattatttctgggtatttatgtctctttctccccaagtatatcataatttctttgatggtagaattgatggctgttttgcttattcttgcctagcacagagagaggtactcagtattttctgattaaataaggacttgcatagtcaaataacctcttccgttttttcttttttctctctcttttttttttggagatggagtcttgctctgtcgcccaggctggagtgcagtggcatgatctcggctcattgcaagctctgcctcccgggttcacgccattctcctgcctcagcctcccgagtagctgggactacaggcgcccgccaccacgcccggctaatttttttttttttttttttttgtatttttagtagagacaggatttcaccatgttaaccaggatgttcttgatctcctgacctcgtgatccgcccacctcagcctcccaaagtgctgggattacaggcgtgagccaccacgcccggccccattttttctttaatagtgagatttagaaacccatcctctctctctctccctctcaaacataaaaaacaacctaagttgtttcacagacacattcttgtaagctttctaggaaataattttctatatccaactgttttgtaacatacccatatacatatagaaagctatccagttcattttatttcaatctcaaatttgataaagtaccaaaaagtagtaatacagacctagttcagtcatgaatatggatgggaaaagtcaatataaaattctagcaaatcagattcagcaggatattaaaagaacatttcataacataagttatacattgaatttaaaaagtaggtgaatattagattaaaaatgaaaaaccacatggtgatcttaatgccacaaaagagtttgataaaactcaatattcattctttataaaagtatttaatggtttggatgaagacttcttcagttaaagaaaaacaaagaagaatttctgtccaaaccaatatcccagtatcttgctatataatgaaatgatagagtcatttctatgaaaataggataaaataaagaggcttgcggatacagccttttttttttttttccaagttctagacaatgcaataaaacataacagaaattagaagcagggcttttggaaaaaaggagatacagttcccatttatttgcaggccgattggttatatctagaaaccaaagagaaaattaaaaacttttggaattagtaagaataggtatgaattaatatgagagttgagttggatacacatgtttttgagctgattcatgcaaaggctttccaagctcctttgtgttttactaggttgtgtttgcttaaagttggctcgctagtacgcagtcatgagtcaggggaagagaaggagcctgactggctcctatattgttctgagtcatatttctttttttcagtggaattaaaccaacatgattgttgaaagagatcaaaatttggcaggttttcatttgcttgatatctgtaaacagacttttctttcaggaaaggaatttggaggagggcagagccatcattatctcttttttacaaatctacaatttcccatttgacccttacaattaatctgaaagtcaatttgtgtttgagattatacgacagtaacaggttgataagcagacatttctatgtcttattcgataagaaatactgaattaagttggagaatggaggtcatgtgctgccccgtacatttctcatcttgtcctcagcaaggactatatggtaattttcatagattttgtcaattaaatgaccgatatttgagtaccttttaagtgctagttcctgttcttggtggtaggattgcagtggtgaagaagatatattctgttcttaagaggattacattgcagaggggatagatagataataagctgtgtataaataagataaatttaattataaataatactgataaatatagagaagataaaataggtattgaccaattatgaatggcatactgtatggcaagagctttttagatggagtcaaagaagtctttgctgaaaaggtgacatttgaattgagtcatgaaggatgaggaagaggaagccatgagggcacctgttctaagagcatttcccagcataaagaactatgtggtgacaataaattcagggacagaaaggaggccaatgtggctgaagaacagtgaactaagtgggagagtaagaagaggtaatgctggagaagtagccaaaaaccaggtcacgtaggaacttgtgggccataagaaggagtttggatttttggaaatgtgttggaaaacctttagattgtttgtttgtttttcaaagtgagatgtttatgatctgtgtggaagacagacaagaagaaaacaaaagtggaagtagaaagaccaggtaggacatcgttgcttgtgctggtggcttgggtccaggtgggtgcaatggagattcagggcagcaagtagaatttgactgatggattggagtggtatgaaagaaagagtcaaggatggccctaattttttgatctgaataataaagtgtataatgaatgctgtttgctgaaatgggcaactcttgagattggaagtgaagctatgagttgagagcactttctctgttttggctgtgttaactctcagtatcccccggaagtcattattatcatttgccatctgaatccattataccctgtttactttcaatttttatgttttttacttttatatttttttggagacagtatctcactctgttgcccagactggaatgcagtggcatgatcatagctccctgcagccttgaactcttgggctcaagtaatccttccaccccaggctcccaggtagcagctaggactacaagagtgtgccactgcacccagctagttttaaatttttttattgttttgtggatacgaggtcttactatgttgcctaggctggaatgcagtggcacaattatagctcactgcagccttgaactcctgggctcaagtgaacttcctgccttggcctcccaaagtgcagatattacaggtgtgagccactgtgcctgttcattttctaagttattttataaataattaacacaagtaaacaatgaaaaacaaccttattagaaactttaataagaatttaaccatagcaaacccaattttttttatcctgtaagttcctggttttgaagacacatacatattcaaaatgagaaaaagtcctttgaatataatcatcaattgctatatacaaacctgtaacatatacattatataaatactgatttccagatttaaaatgaatctcttaatatgttctgggtttatcattacttctggtttttgcattttattgtcaaaaggcagtatttttgaaaactttgatggctaagattttgttgaagaaaggataaacactttcaattgaaaagtatttttgttttttagatttatcaactaatgagaatgatcgatttaatgaaatttgttatttctacatcagttattttttctccacactttttatatagatacttatcatcagcatttgtctacctatgaacttcatcaagtaaatttagcttcataaacatcataaaaagatcaatgaatactaccacatattcttttaactaaatgggatggtctaggatcttgtaacatattgcacaatgaagtttcctgttgaatgactgtctggctaaaagtacttcttgtccttaaaaatcatattgtacattcattccttcttaagtttcagaaaatttatctaggatatcatcatctgaagattcataacctgagatttcactactacctgcctctttacattcaccatctaataactgtgaaatatctttctttgtcagttttcttctctttgccattatgggtagaaaatgaaatattctgaattttcaaccgtgtttactgaaaccctcaaaaatacaaagataggatttccagccttcttttcaaaagatgagacaataccaccaaccaaaaaaagcctgggacctgatggattcacagccagattctaccagatgtacaaacaagagctggcaccattcctacagaaactattccaaaaaactgaagagaaaggactcctccacaacttattctatgaggccagcatcatcttgataccaaaacctggcagagacacaacagagaaagaaaacttcaggccagtatccttgatgaacattgatgtacaaatcctcaacagaatacttgcaaactgaatccaacagcacataaaaaaggtaatccaccatgatcaagtaggcttcatccctgggatgcaagattggttcaacatacacaaatcagtaattgtgattcatcacataaacagaactaaagaccaaaaactacatgattatctcaatagatgcagaaaagacttttaataaaattcaacatcccttaatgtaaaaaactctcaataaactaggtattgaaggaacatacctcaaaataataagagccatctatgacaaacccacagccaacattgaactgaatgggcaaaagctggaaacattacccttgaaaaccggcatgagacaaggatgtcctgtcttaccacttcaattcaacatagtactggaagtccttaccagagcagtcatgcaagagagagaaataaagggcacccatacaggaagagaggaagtcttctctgtttgcagatgacatgattgtatatctagaaaacccaatagtctcagccgggcacggtggctcacgcctgtaatcccagcactttgggaggccgaggtgggcggatcatgaagtcaggagatcaagaccatcctggctaacatggtgaaaccccatctctactaaaaatacaaaaaattagccgggcgtggtggtgggtgcctatagtcccagctacttgggaagctgaggcaggagaatggcatgaatccaggaggcggagcttgcagtgaactgagattgcgccactgcactcaagcctgggtgacagagcgagactccatctcaaagaaaaaaaaaaaagaaaaccccataggctcagcttgaaaactcctccagctgatacacagcttcagcaaagttgcaggatacaaaatcaatgtacaaaaatttactagcattcctatacaccaacaacagccaaactgagagccaaatcagaaaggcaatcgaattcccagttgccacaaaaagaataaaatacctgggactacagctagccagggaggtgaaagatctctacaatgaaaattacaaaacactcctcaaataaatcagagaagacataaacaaatggaaaagcattccatgctcatggataggaagaccccatatcattaaaatggctatattgcctaaagcaatgtacagattcaatgctatttctatcaaactaccaacagcattattcacagaactagaaaaaactagtttaaaacccttacggaaccaaaaaagagcctgaatagccaagggaatcctaagcaaaaagaacaagtgccagaggcatcatgttacccaacttccaactatactacaaggttacagtcaccagaacagcatggtacaggtacaaaaacaggcacatagaccaatggaacagaagagagagcctagaaatcaggccacgcatctgatcatcaacaatgctgacaaaaacaagcaatggggaaaagactccctattcaataaatggtgctgggataactggctagccatatgcagaagattgaagctggatcccttccttgcaccatatataaaaatcaactcaagatggatcaaaggcttaaatgtaaaattcaaaactataaaaaccctggaagacaaccaaggcaataccatcctggacatagaaccggcaaagattttatgacaaagacaccaaaagcaatcacaacaaaagcaaaaattgacaagtgagatctaattaaacttaagagcttctgcatagcaaaagaaactatcaacagaataaacagccaatctacagaatgggagaaaatatttacaaactatgcatctgacaaaggtctaatattcagcatctataaagaacttaagtaaatttaggggagaaaaccccatttaaaaagtgggcaaaggacatgaacagacacttcccaaaagaagacatacatgaggccaacaagcatatgaaaaaaatcttaatatcactgatcattagagaaatgcaaattaaaatcacagtgagataccatctcataccagtcagaatggttatcattagtcaaaaaataacatgctggtgagattgcagagaaaaggaaacacttatacactgttggtgggagtgtaagttagttcaagcattgtggaaagctgtatgatgattcctcagagacctaaaagcagaactgccatttgacccagcaatcccattactgggtatatacccagaccaatataaatcattctactgtaaagacacatccatgtgaatgtttattgcagcactattcacaatagcaaagatgtggaatcaacctaaatgccctcagtgacagattggataaagaaaatgtggcacctaaataccatggaatactatgcagccataaaagaatgaaatcatgtcttttgtgagaacatggatggagctggaggctattatccttaacaaactaatgcaggaacagaaaaccaaatactgcatgttcacacttacaagtgggagctaaatgataagaacctacaaacgaagaaaacaacagacactgggggctacttgatggggagggtgaaaggagcaagaggcgcagaaaatataactattgggaactgggcttaatacctgggtgatgagataatatgtacaacagacccccttgacacatgtttacctatgtaacaaaccttcacttctacccccaaacctaaaataaaaggtgaaaaacaaaagatgaggcaatactttgagtaatgcaataagaaaactgaaggagggtatagtagtacagcatccttttaggcaattctattattcttacaattttagatttttaaaaatatagttgggaataactgataaataatgatgaaataattttcaggatgatggattaccgaaagatttaaggtataggaaaaataagatcactgaggccctgtaatatatcttagatttatgaaagagtccaatggacccatatggtaattgcaagacaaaatgagtgtgttttaaaaacaagtaagagttctgtttgctcttgaatacctctaagaaagaataaattcatgaaatatcaatccttacaaatagaactgcccagaaacaaatttaaaaaacaaatctccagtctagtggtcccagataataccaagggataagtttgaagtgtgtattaaatatcccattggagatgtagagtagtggttgtctccagaaatctaaacctcagaagagaggtctagactagaggtttcagtctgagagtcatcaaccatttgaagctttggatctagatgagatcacccaggaaagagaggataaatggaaagagaagagggccaagaatagagccctgtggcacactagattttagaaatctcatttaggagaaagatactgagagggtgcaaccagtgaggtagaaacctgtgatataacttggagaatagtgttttaggtggggagaagtcaactggatcaaaagataagagtaatttttaaaaaagtaaggtcagagaagtttgatcattgacttttttaagaatagggatctttgatgacccttaggagagctgtttcattgaagtgatgaggctgaaagcctgtttgtgatggattaaaatgaggaagtagagataagcaatagaggcaaattttacaataaattttgctgtgaaggcgggggagagatggtatttggtgagagtttcttttaacccactttagaggattgagaggaattggtagagtacctggaattggggatgtcaatcagggagatattggtaccttaaattaacatattaaggcttgacattaatactctcacattaatactgtatagaatagagcagaattcttctctctccttttctcttttatggatgtataatagaggtacatagtttaggggtacatgtgaaaatatattcctataacttacagagatcaaatcagtgttcttgggatattcatcaccttaaatatttgtcttttctttatgctataaacattcaaattatgctagctatttcaaaatgtacaatagattaagttatagtcaccctactcaccctactgatctatcaaagagtaggtcttatttcttctatcaaaccatatatttgtacctattaatcaactcctcttcatctcttccttgcccatatacttcctggcctctgttaaccaccaatctactgtatctttatgagatccacttttttggctcccacatatgagtgagaacaagcaatatttgtcttttactgcttggattatttcttgacataattacctcccgtttcatccacattgctacaaatgacaggatttccttcttttttgtagctgaacattattccattgtgtatacatactacattttctttatccattcatctgttaatgagcacttaggttgatttatatcttggcagttgtaaatagtgctgcaataaacatgagagtgcggatatatctttgatatattggtttactttcatttggatatatacccagtagtggaatggcttgatcatatggtagttctattttttatttcttcaggaacttctatactattctgtgtagtgattgtatttatttacattcccaccaacaatgtataagggttcccctttgtttccatcctcaccagcattgttattgtctgtctttttgataaaaggcattttaactagggtgagatggtatctcattgtggtttttatttgcatttttctgatgattactaacaaggagcatttgctcacttacctgttggccatttgtatgttttattttcgggaatgtctgtttagatcttttgcccgtttttaaatcagattctttggctttttgctgttgtgttgtttgcgctccataaatattctgattattaatcccttgtcatatggataatttgcaaagattttctctcattctgtgggttgtctctttgctttgtggttgtttcctttgctgtccagagcttttagcttgatataatcccatttgtctatttttgctgtgtggccttgtgctttcgacatcctacacagaaaatcttggcccaggtcagtgtcctggagcatctccccagtgttttcttctagtagtttttcttcagttgttcgaggtcttagatttaagtattttatccattttgctttgatttttgtgtttggtgagagatagtggtatagtttcattcttctgcatatggttaatccagtttccccagcagcatctactgaaaatactgtcttttccccattgtatgttcttggtacctttgtcgaagatgagttggctgtaaatgcttgtatttatatctgtgttctttattctgttccattggtctatgtgtctgtttttataccagtaccatgctgatttggttactatagctttgtagtaaagtttgaagtcatgtagtgtgacccttccagcttcattctttttgcccagcattcctttggctatttggggtcttttgtgattccatataaatgttaagtttttttttctatttttgtgaagagtgttactggtattttgttagaaatagcattgaatctatagattgcttagggtagtatggacatagtaacaatattaattcttctaatcaataaacatggaatatctttcaatttttttggcatcctcttcagtatctttcatcagtgttacatagttttcaacatagagatctttcagttctttggttgattcccaggattttatattcattgtagctattgtagatgggattgctttcttgatttctttttcactttgtttgctgttggtgggtataaaggctactgatttttgtatgttgagtttgtattttgcaattttactgaatttgtttatctgttctaatagtttttttggtagaatctttaggtttttctgagtataagatcatgttgtctgcaaacaagactaatttgacttcttttccaacttgaatgtatgtcctttatttctcttgcctaattgctttggccaagacttccaagattaagtggtatacaagtggtgaaaatggatatccttgtcttgtttcagatcttagaggaaagatcttcaatatttcacctttgagtgcagtgttagctgggagtttgtcatatatggcctttattattttgagatatgttccttttataccctttgtgatgaggattttatcataaagggatgttgaattttatcaaatgcttatttaatctgttgaaataatcatagggtttttgtattggttctgttaattatcgcatttattgatttgcatacattgaaccatctttgcatccctgggatgaatcccacttaatcatggtgaatgatctttttaatgtgctggtgaatttggtttgctagtattttgttgaggatttttgcatctatgttcatcagtgatattggcctgtagtcttctttttttgttgtgtccttatctgtttttggtatcagggtaatgctggcctcataaaaggagtttggatatattccctctggttcaattttttgagtagaattgatatttgtttgtccttaaatggttggtagaatcatcaatagagccataaggttccacacttttctttgatgggagacttttgattacagcttcaattgtgttacttgttattggtttgttgaggttttctgtttcttcatgggtcaatattggtaggttttatatgtgcaagaatttactcatttcttgtaggtttttcaatttgttggcatatagtctctaatgattctatttctgtggtctgagttgttacatcttttcatttctgattttatttgggtcttttttttcttagtctagttaaagatttgtcaattttgtttatcttttacaaaaccaactttttgtttcattgatcttctgtattgttttttaagtttcaatttcatttatttctgctctaatcattattatttgtttccttatagtaattttgggtttgatttctttttgcttttctagtcccttaagatgtatcattaggttgtttatttgaagtctttctactttttggatatagatgtttattgctataaacttccctcttaatactgcttttgttgtatcccatacgttttgttatgttgtatttccattttatttatttcaagaaattttaaaattttttcttcttaatttcttcattgatcctttggtcattccagagcatattgtttaatttccatgtgtttgtgcagtttctgaggttcctcttgttattgatttttagttttattacattgtggtcagaaaagatacttgatatgatttctacttttctaaatttgttcagagttgttttgtggcctaagatatggtctcttctggagaatgttccatgtgctgatgagaagaatgtattctgcttgtgttggtgaaatgttctgttagttagacctagtgtgtagtttaactctgatgtttctttgttggttttctctctgaatgatctattactgagagtagggtgttaaaagttccctactattttttctttttagagacagtgtttcactctgtcactcaggctggagcacagtggtatggtcatagctctctgcagcttcaacctcctgggttcgagtgatcctcctgcctcagcctcccaagtagctgggattacaggtgcatgccaccacatatggctaatttttaaactttttaagtagagacagggccttgttatgttgcccaggctggtcttgacctcctggcttcaagcagtcctcctgtcctggcctcccaacatgctgagattgcaggcataagccatcacacctggctccctcctattattgtattgcagtccatctttccctctagatctattaatatttgcatatatacttcagagctccactgttgtatataaatatttataattgctatatcctcttgctaaaatgacctttctcattatgtagtgaccttgtctctttttatagtctttgatttgtagtttattgtatctgatataagtatagctattcttgttctattttggtttccagttgtatgaaatatcttttccacccttccactttctgtctttgtgtttctttataggtgctaagtttcttataggtggcataaagttgaattgtttctttatctgttcagccagtctttgccttttaattggagaattgagttcatttacattcagtgttattattaatatatagtgacttagtactaccattttgttgcttgtttgtaattcctctcttccttttttactgtcttcctttgtggttattttctttggtagaatgttttaattcattgctttttatttttggtgaatctattacaggttttttgcattgtggtcaccatgaggcttacacaaaacatcttataacaaggtattttaaagagatgacaacttatcttagatcacaaagaactgaagttttaattttatttaatataagttaaatgtaagtagccacacgtgatgagtggatactgtattggacaggacagctcaccacttttatcatgtgccagtaggtgaagaagggaagaattgggtagatcagagtttttccggtagcatctgcattgagatatgccgtaagtgtaaaacacatgctgaatttcaaagatataaaaaagaatgaatttgtcgtcaataattttaattattgattacccattgcaatgatgtaatatgaatatatttggttaaataaattattaaaataatttcacctattttattttatatttatgtaaccactagaaaatttaaaattctacatgtggctcacatttgtagatctcgtatttctataggacagtgctattctgacagtgagctccttatggggaaggacccttttcattttaatcttgactattactgtgtctttaatatagtagatacttaatagttgttgaatgaataacatagtctctagaaattgtgaccataagccttttgaagaattgaggctttgaattaaagcatatatatgatagatacatacataaacacacttgcacatacaggaagaaacctacatctaggaatacaagagtaatagcacttgttttgagccaaattctattaataattgaagaattaagttctcataacagcatctgtaagcaaaattctattaatattcctcatttacaggaaacagagacagggacattaagtaacaaaatgacacagaaatattaagtgatagaaataatttgaattcaggcagtctggctgtgtagtttgtacctttaaccagtatgctaaagaaatgtcatgtaattttggtcatccataattatcactttcaaaattgtgaaaggaggtgtatgaatgaatcctgggcagttttggacttgggggactttttgatgcctcttttgctttcctggaatgaagaaagtttacttaggccttacaatctgcttttaattgctttaagatttattaaagttcagcaagcaaagtctttttttttttctgttcggcatcagcttttatgtttatacttccagtaatatttttttcagctctgggaaaagtataaagaaagtgttgccactggtagtgtatgagtgaaaaattatcatttgacttttgggaaaatgaaatggttatttatatagtggtcccaagaatcaacttatctcttatattattaataggagagatttctgcttggtaatagatttataatactttactttttgggatgaagcaaaaaggcaagaatataagtttatttcccttcagctttctgttaacatttcccacagaaagttttatttcatatctaattgtaaatccagtatgttattattctgaataaatcttttataaataaatagttataaaacaggagggtataaggttcaaaggaaaagatgtattctttttcatttttaacatgctgccacaatttcccatatatgctaagtttatctgttttttctgtttacgtgattcttttcagtagtggcataccttttgctaattcacacacatttgtaagggtattcaggaaaacttagcttaaaaaatatgccatcaaaagattggagatggattctaggtagaaaaatgaatttatctgtaggcattatcatgttgcatgcagaaaatagtctttttttttttctctcttgcttgctcagtctgagctgacaggcagttctgaatattgggcagctctgtttcacactgccatccagggaccttgttttgtttcttctctcttgttctaccattccctaaggtgttgcatgtctgcagagatgagtctgaattgccaccaccaccacattcgcattctagtttgtgggaaaaggggaaaaaaacaagtggaaagcaagcagctttcaaaaaagtatgaagtttagaaaacttcacagttacacacaacacttcatgctataacctattgaccagaacttaatcacgtggacacatctatctgcaaatgtggccatcacctcacatggtaactatattaaaaaaaaattgagaacatttaagatctactcacttagcaaattttaagtttacaatgcagaattattaactatggtcaccatgctgtccattagatttctataatttattcattgtataactgaaacttagaatcctgtaaacaacatctccccatttcctcatcccctgatctcactcagtcccttacaaccaccattctactctctgcttctgagtttgaaaatattccatatataagtgagatggagtatttgtatttctatgctaggcttatttcactgagtataataccctctaggctcattcatgttgtttcaaatgacaggaatttcttctttttaaaagccaaataataatccatagtatatagccttttagtttgatgcaaagctatttgttcatttttgcttttgttgtgtgtgctttgagcatcatatccaaaaaactcattgcccagaccaatgtaaaaaagcttttccctgtgttttcttctggtaatcttacaggtcttacatttacgtctttagtccatttgagttggtttttgtttatggtctgaaatgagggtctaatactacagaccaaatggacctaccagatatataaataacattccagctgacagcagaaaatacattcttttgaagagcacatggaacattttccaggagggatcatgtgttagggcacaaaacaagttttaacaaattcaagaagattgaaatcatatcaaatattttcagccacaatggtatgaacctagaatcactaacaggaagaaaattgaaaaactcacaaatatgtggaaattaaacaacatactcctgaacaaccagtgggtcaatggagaaatcaaaatgaaaatttttaaaaattgtaaagaaaaatggaaacacaacataccaaaacttaagggatgcagcagaagcctttctaaaagggaagttcatagcagtaaacacctacatcaaaaaagactacaggaagacctgcttgaggctgttttacagttaccattttttttaacaaggagaaggagtacactctaaaaacaatgataaaagtataatatagtagatacataaaccagtaacatagtttttattatcattatcaagtattatttactgaatataattgtatgtgctatacttttatatgactggcaatacattaggttttttttataccagcatcaccacaaacaccttagtaatgtattacaatgtctacaacatcattaggctataggaattcttcagctccattataatcttatgggaccactgttgtatatgtagtctgttgttgactaaaacattattatgcacttcatgactatattgcattgctgtttctcctttcacttctgttaatacgtgctttgtttattaatatttagatgttctggtccatatgttgggtgcatatatttttacagttgttatatccttttgatgaattgactcctttattattacataatgacttttgtctcttgtgatagtttttgactgaaagtctattttgtctgacgtaagaatagctacctctgttctcttttagttaccatttgcttggaatatcttttcccatttcttcactttcagcctgtatgtgtgcttaaagctaaagttccttgtaggcagcatatagatagatcttgttttttttttttttttgagacagagtctcgctctgtcacccaggctggagtgcagtggcgcgatctcggctcactgcaagctccgcctcccgggttcacgccattctcccgcctcagcctcccaagtagctgggactacaggcacctgccaccacgcccggctaattttttgtatttttagtagagatggggtttcaccgtgttagccaggatggagatcttgtttttttaagccttcaaccattctgtcttttagttggagaatttaatccctttacatttaaaataattgttgataggtaagtacttaccattgctgttttgttaatttttttctgaatgttttgtagtttgtttcctcctctctttctaccttcctttggaatttgatagttttttttttaataatgatatgctctgattccttcttctttatgttattgtgtatctactacaggtgtgtgtgtgtgtgtgtatgtgtgtgtgtgtatttaccatgaggcttactgatattgtgtatctactacagttgtgtgtgtgtgtgtgtgtgtgtgtatttaccatgaggcttactgaatacatcttataacagtctattttaaactgataacaacttgacttcaaatacctacaaaaactttacactttaacttttgctcccaccacattttatgtaattgatgtcacagtttacatcttttgtattgtatatctattaacaaattattatagctaagttgttttaatacattttaaacttttatagtagagttgaaagcgatttacacaccactattacggtattagcatattctgaatttgaatttatagtaactttttaaaattcatgtattttcatgttgtcaattagcattctttcattttaagttgaagaactcactttagcatttcttgtaaggcaggttcagtgattacaaactccctcagcttttgtttttctaggaaagtctttatctctcctttatttctgaaggacacctttgctaggtatagtattcttggttgacacatttttttttcttccagtactttatttatttatttttttattatactttaagttctagagtacatgtgcacaacgtgcaggtttgatacataggtatacatgtgccatgttggtttgctgcaccgatcaactaactcatcatttacattaggtatttctcctaatgctatccctcccccagcccccccaccccctgacaggccccagtttgtgatgctctctgccctgtgtccaagtgatctcattgttcaattcccacctatgagtgagaacatgcagtgtttggttttctgtccttgtgatagtttgctgagaatgatggtttccagcttcatccatgtccctgcaaaggacatgaactcatcctttttttatgactgcatggtattccatggtgtatatgtgccacattttcttgatccagtctatcatcgatggacatttgggttggttccaagtctttgctattgtgaatagtactgcaataaacatatgtgtgcatgtgtctttatagcagcatgatttataatcctttgggtatatacccagtaatgggatggctgagtcaaatggtaattctagttccagatccttgaggaatcgccacactgtcttccacaatggttgaactaatttacattcccacttacagtataaaagcattcgtatttcttcacatcctctccaccatctgttgtttcctgaatttttaatgattgccattctaactggtgtgagatggtatctcactgtgattttgatttgcatttctctgatgaccagtgatgatgagcattttttcatgtgtctgttgggtgcatagatgtcttcttttgagacgtgtctgttcttatcctttgcccactttttgatggggttgtttttttcttgtaaatttgtttgagttcattgtagattctggatattagccatttgtcagatgggtagatcgcaaaaattttctcccattctgtaggttgcctgttcactctgatggtagtttcttttgccacgcagaagctctttagtttaattagatcccatttgtctattttggcttttgttgccattgcttttgatgttttagtcatgaagtccttacccatgcttatgttatgaatggtattgcctaggttttcttctagggtttttatggttttaggtctaacatttaagtctttaatccatcttgaattaatttttgtataaggtgtaaggaagggatccagtttcagctttctgtatatggctagccagttttcccagcaccatttattacatagggaatcctatccccatttcttgtttttgtcaggtttgtcaaagatccgatggttgcggatgtgtggtgttatttctgagggctctgttctgttccattggtctatatatctgttttggtaccagtaccatgctgttttggttaagtcaggtagcgtgatgcctccagctttgttctttttgcttaggattgtcttggtactgtgggctcttttttggttccatatgaagtttaaagtagttttttccaattctgtgaagaaagtcattggtagcttgatggggatggcattgaatctataaattatttgggcaatatggccattttcacaatatggattcttcctatctatgagcatggaatattcttccatttgtttgtgtcctcttttatttccttgagcagtggtttgtagttctccttgaagaggtccttcacatcccttgtaggttggattcctaggtattttattctctttgtagcaattgtgaatgggagttcactcatgatttggctctgtttgtctgttaatgatgtataggaatgcttgtgatttttgcacattgattttgtatcctgagactttgctgaagttgcttatcagcttaagaagattttgggttgagacagtggggttttctaaatatataatcatgtcatctgcaaagagggacaatttaacttcctcatttctgaaccgaataccctttatttctttctcttgcctgattgccccagccagaacttccaacactgtgtcgaataggagtggtgagagagggcatccctgtcttgtgccagttttcaaagggaacacttccagtttttccccattcagtatgatattggttgtgggtttgttataaatagatcttattattttgagatacgttccatgaatacctaatttattgagagtttttagcatgaagggctgttgaattttgtcgaaggccttcatctattgagataatcatgtggttttgtcgttggttctgtttatgtgatggattacatttattgatttgcttatgttgaaccagccttgaatcccagggatgaagcttacttgatcgttgtggataagctttttcatgtgctgctgggttcagtttgtcagtattttattgaggattttcgcatcaatacagggatattggtctaaaattctctttttttgttgtgtctctgccaggctttggtattaggatcatgctggcctcataaaatgagttagggaggatttgctctttttctattgattggaatagtttcagaaggaatggtagcagctcctctttgtacctctggtagaattcggctgtgaatccctctgattctggactttttttggttggtaggctattaatttttgcctcaatttcagagtctgttattggtctattcagagattcaccttcttcctggtttagtcttgggagggtgtatgtgtccaggaatttatccatttcttctagattttctagtttatttgcgtagaggtgtttgtagtattctctgatggtagtttgtatttctgtgggatcggtggtgatatcccctttatcactttttattgcatctatttgattctttttttctttattagtcttgctagcagtctatcagttttgttgatcttttcaaaaaaccagcttctagattcattgatttttttgaagggttttttgtgtctccatctctttcacttctgctctgatcttagttatttcttgccttctgctagcttttcaatatgtttgctcttgcttctctagttcttttaattgtgatgttagggtgtcaattttagatctttcctgctttctcttgtgggcatttagtgctataaatttccctctacacactgctttaaatgtgtcccagagattctggtaagttgtatctttgttctcattggtttcaaagaacatctttctttctgccttcattttgttatttacccagtagtcattcaggagcaagttgttcagtttccatgaagttgtgcagttttgagtgagtttcttaatcctgagttctaatttgatttcgctgtggtttgagagacagtttgttgtgatttctgttcttttacatttgctgaggagagctttacttccaattatgtggtcagttttagaataagtgtgatgtggtgctaacaagaatgtatattctgttgatttgggatggagagttctgtagatgtctattaggtctgtttgttgcagagctgagttcaggtcctcgatatccttgttaaccttctgtctcattgatctctctaatattgacagtggggtgttaaagtctcccgttattattgtgtgggagtctaagtctctttgtaggtctcttaaggacttgctttatgaatctgggttctcctggattgggtgcatatgtatttaggatagtttgctcttcttgttgaattgatccctttaccattatgtaatagccttctttgtgtcttttgatctttgctggtttaaagtctgttatatcagagactagggttgcacccctgcttttttttttttgctttccatttgcttgatagatcttcctccatccctttattttgagcccgtgtgcatctttgcacatgagatgagtctcctgaatacagaacactgatgggtcttgactctttatcgaatttgccattctgtgtcttttaattggggcatttagcccatttacatttaaggttaatattgttatgtgtgaatttgatcctgtcattatgatgttcgctggtttttttgcctgttaattgatgcagtttctttatagcatcgatggtctttacaatttggcctgtttttgcagtggctggtagtggttgtttctttccatgtttagtgcttccttcaggagctcttgtaaggcaggcctggtggtgacaaaatctctcagcatttgcttgtctgtataggattttatttctccttcacttatgaagcttattttggctggatatgaaattctgggttgaaaattcttttctttaagaatgttgaatatcggcccccactgtcttttggcttgtagggtttctgctgagagatctgctgttagtctgatgggcttccctttgtgggtaactcgacctttctctctggctgcccttaacactttttccttcatttcaaccttgatgcatctgacaattatgtgtcttggggttgcacttcttgaggagtatctttgtggcgttctctgtatttcctgaatttgaatgttggcctgccttgctatgttggggaagttctcctggataatatcctgaagagtgtttgccaacttagttccattctccccatcactttcaggtacaccaatcaaatgtagatttggtcttttcacatagtcccatatttcttggaggctttgttcatttctttttactcttttttctctaactttgttttcttgctttatttcattaatttgaccttcaatcactgataccctttattccacttgattgaattagctgatgcagcttgtgcaggcgtcacgaagttctcgtgccatggttttcagctccatcaggtcatttaaggtcttctctacactgtttattctagttagccattcatctaatcttttttcaaggtttttagcttccttgtgatgggttcgaacaacctcctttagcttggagaagtttgttattaccgaccttctgaagcctacttttgtcaacttgtcaaaatcattccctgtccagctttgttcatttgctggtgaggagctgcaaacctttggaggagatgaggtgctctgatttttagaattttcagcttttccactctggtttctcctcatttttgtggttttatctacctttggtctttgatgttggtgacctacagatggggttttggtgtagatgacctttttgttgacgttgatgctattcctttctgttagttttccttctaacagtcagttccctcagctgcaggtctgttggagtttgctggagttccactctagaccctgtttgcctgggtatcaccagcggaggctgtagaacagcaaatattgcacaacagccaatattgctgcctgatccttcctctggaagcttcgtcccagagggtcagctgtctatatgaggtggctgtcggcccctactgggaggtgtctcccagttaggctacgcagggatcagggacccacttgaggaggcagtctgtctgttctcagagctcaaatgctgtgctgggagaaccactgctctcttcagagctgtcagacagggacatttaagtctgcagacgttttctgctgccttttattcagctatgccctgctcacagaggtggagtctagaggcagtaggccttgttgagctgtggtgggcttcacctagttcaagcttccccaagccgctttgtttacctactcaagcctcagcaatggcagatgcccctcccccagccaggctgcagtctctcagatcaatctcagactgctgtgctagcagtgagcaaggctctgtgggcgtgggagctgccaagccaggcatgggagagaatcaccttgtctcccggttgctaagaccttgggaaaagcacagtatttgggcgggagtgtcctgtttttctaggtagtctgtcatggcttcccttggctaggaaagggaaatcccctgatcccttgcgcttcccaggtgaggtgacgtctcgccctcctttggctcactctccatgggctgcacccattgttccaccagtcccaatgggatgaaccacgtacctcagttggaaatgcagaaatcacccgtcttctgcgttgatcacgttgggagctgcagaccagagctgttcctattcggccatcttggaatgcccctcccttcctcttcttcctgtactttaaatatgtcatctcattctctcctggcatgcaaagtttctgctgagaaatatactcatggtcttaaaatcgttcccttgtatgtgactagtcatttgctgctttcaaaattctctccttgtctttgacatttgagaatttgattaaaatgtgtcttggtaaagatctctttattattaatctatttcaggttctttgggcttcatggatttggatgttcatttttttcttccagatttggggtggttttcatcattatttctttaaataaactttatgccccttctctttctcttttatttctgtaatacatatattggttcttttgatactccataagtgccatagactatcttcactctttttaactccctttgctttttgttcctctgactgggtaattttaaatgaaccatcttacagcttgctggttcttctttctgcttgatcaagtgtgctgtcgaaagctctctatggaatttttcagttcattcattgtattcttcagttccagaatttctgtttgtttcttttttgtggtttctatttcttttttgattttttttattttgttcatgcattgttttcctgacttcatttaattttctatctggattctcttgtagctcactgagcttcattaagatgtttgttttgaattccttgtcaggtaatttgtagatctgtatttctttagggtcatttagtggtgcttcattttgtgcctttgtggtgtcatatttccctgatgattcatgatctttgttgccttgcattagtatctgcccatttgaagaagtaggcacctcttccagtctttactgactagctttggcagggaatgccctgcaacagtcaactatttacagattctggttaggccattttgcagggcctatagggagggcttgcctagtgcctgggtctgtgggggctggcctggtactggggggagttctacagttaagggctgtctggccgagtgcctgggtccacaggggcaggccaggagcctggggccatgagagctgacgtggcagtggaatggccctggaatctgggtccacaggggttgacctggatgttagctctgtaggagtggacctggagcctggggctatagacattgacctggtgctaaggtctgtggtgaagtcatgtgctcacgttactcttcttgccccatacaaagggtatttctctttacactgtgctgtgcagggtaggaatgaatgatacaggtaatgtgaaactgtccttaccgtcttcagtgtgccttcttatttccatgcttcactgaggtgctatactttctcacctggattcctcaggtcttgtgaaagtttttttttgtgcatggattgttgttcaaattgatgtttctatgaggggacaagggctggaaactcctattctgccatcttactgatggcactctagtgtgacttttgaatccgccagtaggaaaccttttatcatcctaagaagcacagatgtgtttagctattttatttgaatttggaaggatagtcagaaggacctggtccacaaaagccagaagaagggacttgattctcaatatactactatttaataaagtcagaattggaaagcctacagattcctgtttcatattatcactacatccatattacttatactatgcatctctcttctttccttttctagaagcattctttttaaaggcttgcttgctttttgttttgttcctaattttcctagttttcttcaaaaatttcctgccatttagtaatgcatattgcttttctagaattatgcatctcagcaaagattacatgaggattcagaaatactttttagcatgacttctatttcttttataccccaaatcttataaacctagttaggtccgcctttgtagttcactgtctaaatctattttcttatattttgattgttcaggtaaaggttttattctaaaataatgaacactatacattgacagaaacaaatggatgaatttcaccagagttactacattcaattatgttagctatctaattcactatatatataaagcttgtagctttgaactaattagggttgtagatttttacctttgtttttttttcttttttgaaaaagagaagcaagcttctgtcttgatttttaattctttaatttagtgcaactgtaactggtggcatgaatttgttattactattggcaaatttctaaatcttgtaacccaaattgctcattctatttttttcagatcaaagccagtgtttaccatgcaatcccataaacaactgcataataaacttaattctatttttgtatttgtttttagttgatgctgtaacaaatcaccacacattcagtgacttgaacaacacaaatttcttaaattatggttctgcatgtcagaagtccaacatggatctcatggggccaaagtcaagatgtcacaggactatattcctttctggagatattaggggaaaactcatttccctgctcaaggtttagacaagctctttctcatttctctttcattctctcttttttttttcatctctttcaatatgattgtaatcccatgaaacatagttcagcattcaggaagaaacaaacttaaactatgtaataatcattaatttatgtaataaacttaatataaaattaaatttaaatatttaagattataactataagataaaaactgtgagttttatctaactcacagtattccaattttctaattatttccttaattgtgatactcagaagacaggagagagagactttactgttgatggtgatggtgatggctgttatgatgttgaacttttgagggtcttagtttcccttttatacacatgtaagtcatccggtagtcttttgatagttgtcttagttattaagatatttgagagtttcctatttaattcagtttgttcagcctattttttttttcattgagatagggtctcactctataactcaggctgccacagcctcaatctgccaggctcaagtgatccttgatccacctcagtctcctaagtagctgggactacaggtatgcatcaccacacctggctaatttttttatttttcatagaggcgaggtctcactatgttgcccaggctggtgttgaactcctaagctcaagcaatcctcttgcctcagccttccaaagtgctgggcttgaaagtgtgagccactgcaccagacctcaacctacttttttttttttttttttttttaaccactggagatcttattttctgactaaatctaataattttttatggaaaatgtaagtatatttgtgaattgacagtagggttaaaggcatgatgccctttggaattgctttgttaacatcagaagcaatatctaagatccccctttttttttttgagacaggatctctctctgttgcccaggttggaatgcagtggcatgatcttggctcactgcagcctcaacctcctgggctcaagccatcctcccacctcagcctcctgagtagctgggaccacaggcatgcactaccatgcccaactagtttttttgtgtattttgtagagatagggttttaccatattgccactttctgttttcgaacttctgagctcaagagatccacccactttggcttcccaaaatactgggattacagatgtgagccaatgtacccatgcagatccttttcttaccttttaaaagattactggaaaatttgaacatgcctcaacattttaacatatgtgaatgccattttgatatgaatgcaaagtggtgctgatatttacatatgggatctatccgtagtaactgacttttgatgctctttctttttagaggttgctgtggactgaatgtttgtgtctccccacaatccctatgttgaaacctaatccccaatatgatgatatctggggattgaggctttgggaggtaatcaggtaatgagggtaaagccctcatgatgggcttagtgccattataaagagagacccaagagagtttgatttctctctctgtcctctggcttgtgagggcacagcaggaagacagcaaaccagcaagagtcatcaccaaatgtgaccatgctggtactgattttaaagtttcccccgtaattgtgaaaaataagtttctgtttaagcaacccaacctgtggtattccgttatagtagcccagactaagacagagatgtttaaattttattgtgctattaaataaaagtaccggtgcctcaaagctctgttgtttagatctaaaagatctaaaggtatgaaatgaatattgttgaggcaggatgaggtggtttggatttgtttatttttctccaacttttattgtgaaaaatttcacacgtcggaagagttgcaagaatagaacaatacagtacaatagtaccagtgtgtcttaattattattttgctgcaaaagcacacttgtactttttctctctaatgtgattgtgtgtgtgtgtgtgtgtgtgtttatctgttttcttccctgacccatttgagagtgagttgcagatattttacctccaaatattttagcatgtatcccatttaggaagtttaacattgatacaatattatgtatcatatcgttcatatgcaagtttctccagttttcagatttagaaatagcaaatgattctaaaagggcataattactttgaaaaattgaaaatcactttgaaaaatctggagttttaaagatgatttaccatatgggaaactgtggcaaattttaaatgaatatcctgaagtatgattctaatccagattgaattcaagctgtgaatttttgttttattttctaaatttttttatttcagtagatttttgggggaataggtggtgtttgattacatgaataagttctttagtggtgatttctgagattttagtgcacccatcacccaagcagtgtacactgtacccagtgtgtagtcatttatcccttgccacccctcaccctttacctccagtccccaaagttcaatatatcattcttatgcctttgtatcctcatagcttagctcccacatatgagtgagaacatacgatgtttcgttttccattcctgggttacttcacttagaataatagtctccagttccatccaggttgttgcaaataccattatttcattattttttatggctgagcagtgttctattatatatatatatacctacctttctcccttcccttccctcccctcccctcccctcccctcccttcccatcccctcccctcccctcccctcccctcccctcccctcccttcccttcccttcccttcccttcccttccacagagccttgctctctcaccaggctggagtgcagcagcatgatcttgtctccctgcaacctctgtgtcccgggttcaagcaattctttggcctcagcctcccaggtagctgggactacaggtgtgcgccaccacgcccagctaattttttttggttttgtatttttagtagagatggggtttcaccatgttggccagggtggtcttgatctcttgaccttgtgatctgccggctttggcctcccaaagtgctgggattacaggtgtgaaccaccacgcctaacccatatataccatattttctttatccactcattgtgatgggcatttgggctggttccatatttctgcaactgcaaattgtgcgctataaacatgcatgtgcaagtatctttttcttataatgacttcttttcctctggatagatacctagtagtgggattgctggatcaaatggtagatctacttttagttctttaaggaatcttcacactcgtttccatagtgattgtttgcattcccaccaacaatgtaaaagtgctcctttttcactgtatccatgccaacatctattattttttgatttttttgattatggccattctttcaggaatgaagtgatgtcacgttgtggttttgatttgcatttccctgatgcttagtgatgttgaacatttttccatatgcttgttggccgtttgtatatcttcttctgagagttatctattcatgtccttagcccacttttttttgatggaattgtttgcttggttttttttcttgctaatttgtttatttgtagattctggatattagtcctttaccagatgtatagactgtgaagactttctctcactctgtgggttgtcaattaactctgctgattatttcttttgcttcgcagaagctttatagtttgattaagtttcatctacttatatttgtttttgtcgcatttgctttcgggttcttagtcatgaagtctttgcttaagccaatgtctagaagggtttttccaatgttatcttctagaatctttatgatttcaggttttagatttaagtgtttgatccatcttgagttgatttctgtataaggtgagagatgagtattcagtttcatttttctacatctgacttgccaattaccctggcactatttgttgaatagggtgtcttttccctactgtgtgtttttgtttgctttgtcaaagatcagttggctttaaatatttggctttatttctgggttctctattctgttccattggtctttgtgcctatttttataccagtaccatgctgttttaatgactatggccttatagtgtagtttgaagtcaggtaatgtgatgcctccagatttgttctttttgcttagtcttgctttggctatgcgggctcttttttggttccatatgaattttaggattgttttttatggttctgtgaagaatgatggtggtattttgatactgcattgatattgagaattgcaattccagtttgatattgggaattgcattgaatttgtagattgcttttcttttggccgtatggtcattttcacaatattgattctactcatccatgagcatgggatgtgtttccatttgtttttgtcatctgtgatttccttcagcagtgttttgtagttttccttgtagaggtcttttacctccttggttaggtatattcctaagtttgtttgtttgtttgttttgcagctattgtgaaaggggttgagttcttgatttgattctcagtcaagctgtgaattttcaatatatttttgggcataaaaactatctttaaatggtgtgaggacttactatgtatattttgatgttttcttatagtttatatactttcttgtgaagacaaaaatagggggtcttcaaagtcttttttttttttttttttgagacagggccttgcgatttcacccaatctagagtgcaatggcatgatcatagctcactataaacctgacctcctgggcttgagtgatcctcccatcccagcctcctgagtggctaggactacagtcatgtgccaccacgtggctttattttttattttttcgtggagacaggatcttgctatgttgtgccaccacatggctaatttttaatttttttgtgtgtggcaacagggtcttgctatgttgcccaggctggttgcaaactcttggcctcaagcaatactcctgccttgactttccaaagtgctaggattacaggcatcagccactgcccccagcctacaaagtcttgaggtacgaattaggggaaggtttcttgtcaagttttcttttaactctaaaattctatggctttcaataatttaacagatatttaaactattaaatatgtaacattgtattgggtgctctaggaaatgtggataatccttgatcaccaagaattcaagggaattaagaacttatttacaaataaatgcatgaaagtaaactgtatatgaagacttgtaagaaatattttaacaaagtgcagtgaaaattcagagacagaagaaacttggctgggtggtaagaatagaacagataagcttcattggattgtaaatacttgttaacagaaatccagggtctctactataattttcctgtgtatacaataattttaactggaattaattgtattaacccatttatgccagaagttgcaaatttttttttgtgaaaaatcagatcttggtgataaccttgagcagtaggataaaaataactcccacaagcttagtgttccagtaatggaacactaggcataaatgtattaataagcatgaggtatgcataattcaattagattaaccaaaaatagggaaatacttatgtttgtgatatattgcaagtaaaaattattgaaatttttattgaaaataatacattataacaaatttaagtgtagtaaagtagaaattaaaaagaaaaatgtcatctatagccacctcattcatagataatacctattgacatctgttttttttttcattttttctatattgtgtgcatgcttatatttgatgttgcattctgcttcaaattagttgataaaataattttttttcactttagtaccacacttttgcaagcaattttattggcagcataatattatattgagtagttgtggcatgatttactaaaacatttttctattgtttaacaaaataattaattctttgtaggaacaagcaactgtagaaatggtaaagttatgatagagaacaaacttgttccaagatctcttggaaggatcttccttaattttttatcctgacaatttaatacaccaaatattttacatgatttttttcttgcttttttttactactattttaacttaccgttattaaattatttacgcttttcattacatctagtttagaaaatttagtgtttcattgactatttggaaagattattctgtatatgctcagagaagtggtagaagcatcaagccagctgatgtggatcccaaagggtttggtgcaggaacatctgtagtggtgcatggccagggacagccatccccataggctcaacttgctcctataggagtctttagtgctaggggaactgtcagtcctcaactctgcaggatggtcttgcccatcagatgaggcaggtccaacctgagcgccccttggtctgctgacccctcccaggccccattcctgcttgcagggcagcctcaggtgccctggggggcctgcattatagcttctgtactggtagaccatgggtgatcagtggagagtttcagcagggtggtttctgtgggcatgaaccagcctgcatactccctccctatgttgcagtttcccctaacccatggcaacttactcagctggcatgtatctgtgtgggtgagttttgctttcctttgccacaccagtgtgagggagtgcagtccgaccccctccacccaccaactgccattgcaggcagagccttggcagacacagccagccttctccaaccagcagcctgcccttgcactaacactgctgtgggagtcaaactaggcacagagaacagcagatcctccccagccctgagtgacaactcctgcttgcagggcacagagaaggcacccagacctgcacctgccagtaccccacccctgagccaacaccatttctagcatgactgtgcgcacagtcaccagcaggggccccctgcgccctgctccagctgcattcccttcactactctggtgaacacccacatggagacaggcatcctggcacctactagcactctgccacagctgctgctaccactgctgctggcacatgcaaatgaggatggatcctgctgtcattgcactatgaaatgctttcattcacaccacctatcagagtgtagtgaccagcggtctgggaacaccttaggccccccccgaccccagcacagtggatttctaacctcgaggagccagagaacaaagagccaatgcaagtccgccagagttagagcacacagtcctggagttgagagctgagcagtggccctctaacaccttccagaaatgaagccagtctgctgaattcacctataccacagtcaaactcttatggtcatcaaatagaataaaaggaaaaaacaaacacccaaaggtcagcaacctcaaagattgaaggaggataagcccacaaagatgagaaagaatcagcacaagaaccctgacaactcaaaaagccagagtaccttctttcctccaaatggtcacatctccgttccagcaaggattctgaaccaggctaagatggttgaaatcacagaaataagattcagaatgtggataggaacaaagctcattgagatacacgagtatgttgaaacccaatccaaggaagctaaaaatcaggataaaacaatgcagaagctgatagacaaaatagctagtatagaaaagaaggttacaacccaacagagctgaaaaacacactacaagaatttcataatgcaattgcaaccattaatagcagaatagaccaagcagaggaaggaatctcagagctagaagactggctttctgaaataagacagataagaatagaggcaaaagaatgaaaaggaaggaacaaaacctccaagaaatatggaattatgtaaagagaccaaatttatgactcattggtgttcctgaaagagatggggagaatggaaccaacttggaaaacatatttcaggatatcatccatgagaacttccccaacctacctagagaggacaacattcaaattcaaggattgcagagaacccaagtaaaatacttcacaaagaagatcatccccaagatacatactcatcagattctccaaggtcaaaatgaatgaaaaaaatgttaaaagaagctagagagaaaggtcaggtcacctacaaagggaagcccatcagactaacagacccctcagcagaaaccttataagccagaagagattggatgccaatgttcaacattcttaaaagaaatcccaacccagaatttcatatacagccaaactaagcttcataagtgaaagagaaataagatccttttcagacaagcaaatgctgagagaattcattactaccagacctgccttacaagagcccctgaaagaatcactaaatatggaaaggaaagactgttaccagccactacaaaacacactgaagtacacagaccagtgacattgtaaggcaactacataacaagtctgaaaaataaccagggtctgtgacagtgtcagatccaaacatactaatactaaccttgaatgtaatgagctaaatgccccaattaaaaggcagagagtggctagctggataaagaatcagacccattggtatgctgtcttcaagagaccagtctcacacggagtgacatacataggctcaaaataaagggatggagaaaaatctatcaagcaaatggaaaacagaaaaaagcaggggttgcaatcctagtttcacacacaacagactttaaaccaacaaagatcagaaagatcagaaaagacaaagaagggcattacataatgataaagggttcaattcaacaagaagtgctatatcctaaatatacgtatatacacccaacacaggatcactcagattcataaagcaagttcttagagaccttcaaagacagattcccacacaataatagtgggaaagtttaataccccactgacaatgttagataattgagccagaaaattaacaaagatattcaggacctgaactcagcacaggatcaaatggacctgatcaacatccacagaactctccaccccaaaaaaacagaatatacattcttatcattgtcacatggaacatactctaaaattgatcacataagtggaagtaaaacactcctcagtaaatgcaaaagaactgaaatcataacgaacaatatcttggaccacagcacaaattagaaatcaagactaagaaattcactcagaaccatacaattacatggcaattggataacctgctcctgaataaactcttggataaataatgaaattaaggcagaaataaaagaagttctttgaaactaatgagaacaaagagacaacataccagaatctgtgggatacagccaaggcagtgttaagagggagatttatagcactaaatgcccacatgaaaaagttggaaaggtctcagcttgacaacctaaatcacaactaagagaactagtgaaataagagcaaagaaatcccaaagctagcaggaaacaagaaataaccaaaattagagcgaactgaaggatatggagacatgaaaaaccattcaaaagatcagtgaatccaggagctggttttttgaagaaattaataaaatagaccattagctaggctaataaagaaggaaagaggaaattgaaataaatgatcagaaatgacaagggtgatattaccagtgaccccatgaaaatataaataaccatcagagaatattatgaacacctctgtgaacataaactagaaaatctggaagaaaatggataatttcctggacccatataccctctcaaaactgaaccagcaagaaattgaatccctgaacagacaaataacaagctctgaaattgattcagtaataaatagcctaccaaccaaaaagagcccaggactagacagattcacagctgaattctaccagatgtacaaagaagagttgataccattcctactgaaactattccaatgaagttaaggaggaggaactcctctctaactcattctatgaggccagcatcatcctgaccaaaacctagcagagacacaacaaaaaaagaaaactttaggccaatatccttgatgaacactgaagcagaaatcctcaaggaaatactggcaaatcaaatccagcataacatcaaaaagcttatccaccatgatcaagtaggttttatccctgagatgcaaggttggtgtaacatatgcaaatcaataaatgtgatttatcacataaacacaactaaagacaaaatccacatgattatctgaacaggtgcacaaaaggctctcaataaaattcaatactacttcatgttaaaaactctcaataaactaggtatcaaaggaacatacctcaaaatagtgagagccatctatgacaaacccatagtgaacatcatactgaatgggcaaaagctggaagcattccccttgaaaacttgcacaagaaaaagatgccctctcttggcatcctttttccattctcttggaaaagaataccactcgttttcaacatagttttgaaagtcctggtcagggcaatgaggcaagagaaagacagagcatccatataggaggagaggaagttaaattatctctttttgcagatgacataatcgtatacctagaaaacaccccagtcccagcccaaaagctcctccagctgatacacaaattcagcaaggtctcaggatacaaaatcaatgtgtaaatatcaatctttcttatataccaacaacagtccagctgagaaccaaatcaggaatgtaatcccattcacaattgccacaaaaagaataaatacctagaaatacagctaaccagggagatgaaagatctctatgaggagaactacaaaatattggttaaagaaatcagagatgacacaaacaaatggaaaaacattttatgctcatggataggaagaatattgctaaaatggccatactgcccaaagcattgtatagattcaatgctattcctgttatactaccatttacatttttcacagaactagaaaaaactattttaaaattcatatggaaccaaaaaagagcccaaatagccaaggtgatcctaatcaaaaagaacaaagctggaggcattatgctacctgacttaaaaccgtactacagggctacagtaaccaaaacagcatgatactgctacaaaagcagacagatagaccaatggaatggattagagaacccagaaataaggccatacacctacaactatctgatcttcaacaaacctgacacaaacaagcaatggggaaaagattccctagttaataaatggtgctagataactgactagagatatgcggaaaattgaaactggatgccttccttacaccacataaaaaattaagctggattaaagactttaaaatcccaaactataaaaacgttggaagacaacgtaggcaataccattctgggcataggagtgggcaaattttcatgacaaagatgccaaaagcagctgcaataaaggtaaaaattgacaaatgggatctaattaaacgaaagagcttctgcatagtggaggaaactatcaacagagtgaacagacaacctacagagtggcagaaaatatttgcaaatgatacatctgtcaaaggtcaaatatctagcatctgtaatgaacttcgatttacaagaaaaagcaaccccattaaaaagtgggcaaagagcatgaacagacagttttcaaaagcagacatacatgcaatcaacaatcatgaaaaaagactcaacatcactaattactagagaagtgcaaatcaaaaccacagtgagatactgtcccacaccagtcagaatgctattattaaaaagtcaaaaaacaacagatgctggtgaggttggagagaaaaaggaacacttatacgctgttgatgggaatgagtgtaaattagttcaaccattgtgggagacgatgtggcaattcctcagagacctaaaaacagaaatgccatttgactcatcaatttcatgactgggtatatatccaaagatttataaatcgttctattataaagacacatgcacttatatgttcattgcagcactattcacaatagttcgcaaagacatggaatcaacccagattcccaatgatagaatggataaaggaaatatacaccatggcattctaagcggccatcaagaagaacgatcatgtcctttgcaggaacatggatggagctggaggccattatccttagcaaacaaacacaggaacagaaaaccaaataccacatgttctcacgtacaagtgggagctaaatgatgagaacacgtggacacgggaacaacacacgctggggactatcggaggatgaagggtgggaagagggagagaatcaggagaaataactgtgtactaggcttaatacttgggttactaaataatctgtacaacaaacccctatgctacaagtgtactatataacaaacctgcatgtgtacccttgaacttaaattttttaaaagtttattaaggtgaaaatggttattgaaaaatcttaatctctgaattagtaacagttcccacatgctaaatgatgtatcccaatatctctttatttaaaatataaaactaggcagaaactgaaattattttctagtaggagagtcttttaaaaggtagcattcataagtgttgtttacatattatgcatgggtcactgacaatcaatgtgtctgtaaacaactctgttgtagttagggctcttttcccttttgaattttgattgctcagccaagggttctttgttgatagctggtttgagtacttttatatactatacttaattcagattaatgagctttgttaatactgatttgaactagctagattttatttgtttacttgtttttgttatttttaagaacgaccaattccagatctatgctaatttaaatatgtcctcaaaaagggggcacatatttaaaaaaacaaaccaaaacatacatttatgttggaaaaatcttcttagttcattgttagtaccctaatttttgtaggttttcataggaattaactctttcaaagcaccttttagactatgttgtcggcagctagatgctccatttacttcaagaaatgcaacaaaattgaaaccagtttaactgctaagtgattcgaagtaatgcaaagtacatggactgctaaatcatagaggatctaatttttttttaaaacccatttgttaggctctcatataaatataacacttaaaacaataagcacatatactgttatataattcaggaagatttttagcttgtagacttccaaagaatgtggcattttgttttagtttttgaagtacctcttttttttttttttaatttcagtaggttttcggggaatgggtgttgtttggttacatgaataactttagtggtgatttctgagaatttggtgcacccatcacctgagcagtgtacactgtactcagtgtgtagtcttttatccctaactcctcttccaccctttcccccgagtccccaaagtccattgtacgaagatactgtacctttcttttaatgccagtttataatgcatgttcgaacttttaacttcactaagtctatgaaggtaagatatacatagtaagaactaaacctgctaaagatcatcctgtttatgcaacatcattaatttaacaaataagcagagtaatgcatttaggacaaaagtttatgtttgttattagggatataaagtctgttatccccaggatcttagagactaagagagtagtataaacaaatatttatagtaaactctgtaattactatagaaaatatcacagaagcacaacagctcagctaactctgccatattaaagtagagcagtattatgactgaataaatcaaaacagctgacatcattagacctgctatgattgataacaggtttttctctttgacaagtggttgtgatatatgtaagaattcctagtttttctttaatatgatagataaacctgactaatgattttgaagcatttagtggttgaaatctttctgtgagctttttgtttatcttttatttttagcctgatagtctgataaaggaactgtgctttaatttgcttcttttttgcttgttgctaatgctttttatgatttccaaatatttcaacttcattgttgaaaaatgaacatattttcaggtagatattatattttaatggattacaacttagattttaaatttgctgaaatttttctttgccaggggtaaggtttctggtcaatataaatagaatcatcatgtgtttctgtctccaaaaagttagctgcatattttctgaatttgaggtttgaattaagaattgggaatgccaattgatagatggatggttaaatgcttatgatagctcactgtctatgaaatcctatatgtgtttgttaaatgtgaccgtcagcactaagtaaatcggtaaatagattactttcccaccctaaggatctgcagagtgtcttagaatttcacaaaaggagcaaacctctgacttgatggaataaattttgataatcagtttcttgtttgtttatctgtttattgatctatttcttagtataattatgattgcattttatattggacttttgttttttacctttttaaaaaaaccacattgagccaattttcaattgtttaaactttcagcatgtttaaatatttgtgtttatagttttcagaatttttgctcagttttggaatagtaccgattaccaaaggtaaacctgacccttaatgagcaagtaaatttgtaggctgtatacatttttttaaagtaattgttatctaggccacattagccttcaagctacattgtctattgactgaggctccttagatctcttataaaatgcattatattgcctgacttgcatattatattatctaggtaaagcaatgtaattaaagcttaactgaggtcatgggtggtggctcacacctgtagtcccagcactttgggaggcaaaggcaggcagatcacttgaggtcaggtgttcaagaccaacctgggcaacgtggggagagcccgtttctacaaaaatacaaaaattagctgggcgtgatggcgcatgcctgtaagtcccagctacttggaggctgaggtgcgtggatcacttgatcccaggaggtggaggttgcagtgagctaagatcacaccactggaataggaacagctccggtctacagctcccagcgtgagcgacgcagaagacgggtgatttctgcatttccatctgaggtaccgggttcatctcactagggagtgccagacagtgggcgcaggccagtgtgtgtgcgcaccgtgcgcgagccgaagcagggcgaggcattgcctcacctgggaagcgcaaggggtcagggagttccctttccgagtcaaagaaaggggtgatggacgcacctggaaaatcgggtcactcccacccgaatattgcgcttttcagaccggcttaagaaacggcgcaccacgagactatatcccacacctggctcagagggtcctacgcccacggaatctcgctgattgctagcacagcagtctgagatcaaactgcaaggcggcaacgaggctgggggaggggcgcccgccattgcccaggcttgcttaggtaaacaaagcagccgggaagctcgaactgggtggagcccaccacagctcaaggaggcctgcctgcctctgtaggctccacctctgggagcagggcacagacaaacaaaaaggcagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacagaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcctatcagactaacagcagatctctcggcagaaaccctacaagccagaagagagtgggggccaatattcaacattcttaaagaaaagaattttcaacccagaatttcatttccagccaaactaagcttcataagtgaaggagaaagaaaatactttacagacaagcaaatgctgagagattttgtcaccaccaggcctaccctaaaagagctcctgaaggaagcactaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcatgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctgagtgacctacaaagagacttagactcccacacattaataatgggagactttaacaccccactgtcaatattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaatcgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaacaggaagaagttgaatctctgaatggaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactaccttacttcaaactatactacaaggctacagtaaccaaaacagcatggtactggtaccaaaacagagatatagatcaatggaacagaacagagccctcagaaataatgccacatatctacaactatctgatctttgacaaacctgagaaaaacaagcaatggggaaaggattccctatttaataaatggtgctgggaaaactggctagccatatgtagaaagctgaaactggatctcttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcactcgtatgtttattgcggcactattcacaatagcaaaaacttggaaccaacccaaatgtccaacaatgatagactggattaagaaaatgtggcacatatacaccatggaatattatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggaggggtagcattgggagatatacctaatgctagatgacacattagtgggtgcagcgcaccagcatggcacatgtatacatatgtaactaacctgcacaatgtgcacatgtaccctaaaacttagagtataattaaaaaaaaaaaaaaaaaaaaaaaaaaaaaaaaaaaaaagatcacaccactgcactccagcctgggtgtcaaagcgagaccctgtctcaggaaaaaaaaaaaaaaaaaaaaaaaaggcttaattgattgaaccagattcgagaaaacagtgctaaattataattttctcaatactgtaaatatttttcaatcttcagcttcattaacttctataatttgaaattatcccaattattacctgacatgtactaaaattccctaaaatggatcttgagtaacattttcacagtacgataatttttctctctgtatatatttatatagtcacatatatgcacatacattatacaagcattacttttctataactgtaaggtcagaatttgaagttgtgttttctttatctttttatttccaatacttggcatcaagttgatattcattagaagtaaaggaggaaggaaatgaataatcttcagatactaagaacattacacttaaattattattaaatctaatttgcattctcatatattggcttagcttggttatttgtaacaagaatataaaaatatatgtgactgggaatgacatgaatagaaacttctggaaaatggaatggtaaggtctagagaagtggtaaatatttcatcactggaaatgagcaagcagaggttaggttattctttgacattgatattgaagcagagagtctctataatggatagaaagttcaaagtgacctttaggatcttttatcttcaaatttctatgaaaagtatatttactttaataataaggttaagatgttggagtgcatagagtaaaaaactagaaaagaaccagatgttagaaaggagatttcttaacaaaatacggttaaagaggatttctcatattttatatggaaagaaggaactttgatatttaagtaggaaccatcttctaggggaccctgttgattaaacaggaaatctagaaactagacaaagaaaaaaagaatttggctatatgaaagttaaaacttatattgcaaaagagaacataaaattaatagtccaaataaaattcagaaaataaaatatttgtaacagagatgccagataacaaatttgtatctataatatggaaacaactcttataatttgtttagaagataacccaatggataatgggcaaaggatatgaataggcaattttggaagatcaaatttagatggtcagtaatgtttcaaaagatgctcagacttattaactgttagtgatatgcaaattaaaataacaccaaactatcattttacatgcataaggttgtcaaagattaaaatagtcaaaacacttactactttggcatggggatgtgggaagtgatttgaatacattgctgttggaaatgtaagagttattttatctcttttttggaaggcaatctggcaatatttattaaaatggaaaatacacatactctatgctccagtaattccacttcaggaaatatatccctaagaaataaaagtactggtatgtacaaggatgtttatttcagcactgtttataatatcaaaaattacaaacaaaataatgcttattaatgggatgggtaaataaattatagtatattgcggcacagatcattatattactatcacaaaaagcactatatgaattagagggactttctgtgaggtactgttgaatgaggaaagaaagatatacagaagtatgtattaatatatccaattcttttgtagaacagtgaccaaaatcctgtgtgtgagtttatgtatgagtgtgtgaacctacacatttatatgttcatatggcagggcagtatgtagcaaaagagaagaattcatactcagtggttagcatgtttttagagagttataataatacaacaggagtaggaaggaaaagggaggtaggcccataccaggtaattagatgtgagaatggaactcaaagagcaagtcaagactcaagatttaaatttgggagtgaactatagaggcaatattagatgctaacaaaaccgaatgtaatggctaaccctttaacatctatctgtattttttgtcctatattttaatcagtttctgcttcaccttggtcagcaaaagctcagcaataggttttgtaatattttctgttttaactagctcaaataaacacatattaattgaaaacttctaacagcttttatttattcaacaaatatttcttgatcacctgctttctggcaggcattgttatggcccctgcaatgacaaataagacatacagggtccctacataataaataaataaataaataaataaataaataaataaataaatatataatgtcagatcacataaaagctatgaagaaaaagcattttttcaacggataataagggacagagcagggaagggaaaaggagaggaggtttaactattttggataaggtagtgaggaaaagttttctttcagaaggtgaatttgacaaaagagctgaatgaaatgaagaaccagcccaactgtatatctgggagaagaacctgtcagtcagatagaacaagtaagaagaccttgaggccttgacttattctagaaacttgaagaccagagtgactaaagcatagggacatagagtgtgaaaagatgagttccaaaaggtaggtagggcctgatcttgtagggcgttgtcacccttgtaaggagacaggattttattctggttgtgatgggaagctgtggagggttatgagcactggaagattatgacattggaggctgtgctaatttggatttaagaaagctcactctgattactctgtagaaaattgattatagggtataagaggagaagcaagaaagactattgctctggagtaggcaagagatgatggtgaccctattaattagtagaagtagtgagaaaggtgtcagatttcagatacattttgaaggttaagggaggggtgcttgaagatcatgagagaatagactgatatattttagttgagtccactttggaatcacacaaaactatttttaattttgaatatactttagtgcccccagcattaattatgcagaacgttttaggctgtttaaaagcaaagcagataaattaaaaggaggttagtggttaaaacttctctttcctataaatctcaaagcaatcacaagacccctccaaacctcatatccctttttttttttttgctaatggttgtagatcacaccagtgttctacatttcatattctctcagaacttgctttgaccctcaatgtcgttctgttgtaatgataatgaaagttaaggtaacaaaaaccacttattgtttatcatgtgcaaagtattggtttaagtgcttttgctatattaaatccttttatcctcaaacaaccctattgtaacaaaaaccaagttcagtagcttgccactcacagagtccaattaacaagagcaaggtctggtataaagacagctactttttattccaaaggtagcttataggaagaagtataggcttcctgccttaagggtaccacttcccttttggagcagaaagagggtgcttttaaaggggttgcctggcacaccggcatgaatggcatgcaggggagaaagcaagcaggtggggagtcgatgtactagctttggtgctttatctactgggtagtcgagctggtgactgctggcgccttcttgggcaggcctaggttgtaaaaagcatcccaaaactctccagatgggagagagattcatagtgagcatgctttgggttgtagatggactgttgtctcttgaggcaacctcctgatgggtgagagttctgctctggagcttctaagtacatagttagatgaacttgccctgtaggaaatgtctggtaaagaggaagtaaaatagagctaagtaaaaagttggggaaaggagggaagagaaaagaagagagagagagaaaaaataattaaactatctcttggaaaattgggatacactatgaggtagctgctgtagctgttttacatgtgaggaaactactagtatatatgtactgtaagtggcattagataaactcagcacctaagcctactcagcatggcatattatattttatagtatcctctctactacttgtaaggggatagcgtttatgttatttcactaatcttttatatttttctgttttacatggtattgaaaaacggtaagcagaaggtttgagggaatagataatgctttaaaattttggcgtctgtaaatctaaccttttctcttatacttccaagtttgaatatcctgttgatttttttcttagaccacccaaatatcttgaaaattaccttgcttttgaacctaaacagtgtctctcagataacatttcacctctagaagttacacaaaaatctttcaacagataatgtcttgatttttgattgacagaatatggtcattgtattaccttatctttgtatcctcagtgcccacatagcacttggcacacagaaaatgcttagtgaatgtttactgaatgactgaatggagagaacagtttctctgtataatgtgatctcatttttacctactaaagaaagacaggtttgctttctaagatgggaaaatatgatcactgactgccccagattagacaccccagtggaaagagagaggttctatcttccagtattcatgtcaaccttattgaagaactctggcccttttgggggtcatgtgcctgctctttggaccaatcattactgccaaaaaaaatgagctattacaactggctaagcctaggtcaagttttccttttaatggccatggaggtatattgcattactgaaaggaaagctatgtggagcttgagcaaacaaagaatggcagctgtaattatccacaacaaaaattatatagaattaaaatttccaaacaagtctcaactcttgtttgcaattttatgaaaattataaatttatgaaaaagtgcaagttaaaaagaaaagaaacatggtatgtaaacatgggaaatgtacattttagtatttttgttaaggggaaagagaagcagaggtgaactctgtgaagtgattgaaaatagaaatcttaagggtaggcacctctcttttcaagtttccgtacagagattttaattcctttggtcaaaaggctgcaattcaagttgtttttgcaggcctggctcatttttccactgttttcctcatgggctcaaaggtctgttgaagtggtaaataaacgtgctttgaagctatcacaactcaccttgtgtagttgaacttgcttaggggcagttatcacagttcctagtaagccaagcttgtttctgacagctatggaggatgtgagaaagaacagaattggatagagaaccatttgggaaatgggagagatgtgagtgctgatatgctttcccctccatcgctaataaacttctagtgctattccttgttcttttaaatgtacctatagacattttgctctatgcaggaagtattccctaatgaaagaatggagtcagagcaaaaggaaacatctaagctttattgatctgtgcttatcttacattgctgctctctgctgagaaattgattgatttttttaaaaaaaaaacttcaggagcctttgttggatgttgccattgctgttgcaaaataggaaaacagttatgcataaattatctggagaaaatattttccttgatttttttttctttctaaaaatgtgtgggaagaaattatacaaagtgagtaaatggtggtattatttagaaaccattctattttcacttaggcaaccctaacattaagcaagaggatctttgtggagaatttactgttaatattgtttgcatatttacccaaacagcttgatataagggtttgtttttttgttgttgttgttcttaaattaccattttgagatctagaaatttttcccagcccaaataacaacaaaatcgtttactcattttaaaactttattgtttaaaaaaaccccactaacaaccctaaaatgaatgactccgtagttatttttaccttctttttatgaattccctcagctgaaattaggataatgttttgttttttccatcactattgaatactattcaattatcttttctttttttttttttgttttctttttcccaaatggctgttgaatttatttgcttgatcaataatggtcctggcaaaaattagttaaccaatgctgagacatttgtaatgaaatactaattttaaaaatccatgacaccttgatagaaattagagtttacacaaacaaaaaaggaaccttcgatattgccagcagctataaagtgaacgtactgagaccgacaggacagcaagaaggcatttgcacatttatatctgacacccgaccatactttcagtcaccagaatatcttctctccagatttaaaaaaatagtatgctgatttctataacaaagctttttttcgtacaaaaatcaaataatggccaacgagtcacaacagtgcaataggtagaggattaaaaactgcatcaaacaggtgctgaaaataaatactacctaggagaaggaggtgagagccctcgtgtggggtttgttttcgaccccttgagtgtgtgtggggtttgtcttccgagccacgagcctggcctgtctcgcggtgctgttcactctgacagagtgcgcctgcagcacgttgcctccagggcccagcctcccagaagcctcagagcatcagagcatccgtctcatcggatggacctcaattatcttttcatagaaatgatgtcattgttatacacatgcagtttctgtggcattggaatgagcgtgacaccataaaaataattcttaaagattgtcaatgtagtgttttctatatcattgtttatgagagttatggtttctgttgtttttcgtgcataaaaaatgcaatttttaagtatttttaaaaatcaaacatttgtaaaccataatctcctgcatattgttggtactgtaagtgctacttaggtaacagaaatgttataagtatttgataagatgcttctaaacattatacataagaacagtaggcatttaagataaacagaagtgtaaaatacatttaatcctaggccttgacttttttttttttttttttacattctggataatattatctactcccatgacatttcaagtggatttacttgtgtaaatgtgcacatgattcaaagcaccaaatatctgtttggtcttttcaataattcttcctgggtagctatcccttctgctaataacttcatctttcatcaagactaaaaataaacttttgagatatcgcccttaagtttttctctacttagactgtttctctttcacgctgttgccagattatctttctaaaggcaaaatcttggtcatatgacattcctgctgaaatatctccaacatcttatgttgtatagaggagaaattctaaactctagcatgaacttagaggccatcagcaatctgtccttagcctaattttactagtttcatagtttgcccagtgatcctcctctaaccaccatattattaagccacatttaactgcatgctgtttccacacctgcctttatgaatccatcttcacacgcactgtttgccctgagtatccttattttgccgctcaaatgtcccttgatttctctaggattctgcatccttataacactgtgcctagatcaccataacattaatacattacattacagttaattgttgaagtctttctcactagactagggaccctttaaaagcatgaactagccaatatttttgtaaatcccttatcctgtgcccattgtggggacttgacatgtggtaggtgacatgcctttatatattgtattgggtgcagttgcagggtttaaatactttttccctctgaaagaacttgtttgaactgtaaaagtgtctaaggaatatagtacctttttcccctatcacattcttccaaagtaggacctgttaaggatattctggtaatttagttgtgggtagggggaggtaaccttaaagtatgaaatataaaatcttgttataattcacttgacagtaaatatttaaaactaagttaaatagcccaagagagttatctatactaacacaagttaggaaagaatgaaaagatggttgttagaaacaaatgcttcgtgctgcaaagaagaatcagcactctggcaaaaagctttctcagcaaggcaattcacttctgaagaagggtgccactcatacctggtgtggtcacaagagcacaccgagcagggtatggcaggggtttttatccctaacaaagttcctagcacttctgtgtcctttccccattggctgggtttggacctcacaatctaagctaacttgattggctaaggtttaaaattgaatacagttaatttccatgtattaactttctagacaaccttgaacaggtccttgtacaattaaaagattgggtcagatcatctggcagatttcttattgggtagttacaaatgactagataaatagtagttccataaaatttaatttctaagataggacatttaatgaatttactgaagctgatattgggctataacttaaatggttttgactcagtgaaagttgagttaatgaaggaaaaagtcacctttcaggagcatttgctcccaggggtggcacattaaacagcattattgtgattatgatctttacctcttcccccaaactcccttacataaccaaaggtttcctcttaagtcttctttatttctctttaaatgtagaggtcatttagttctttaagggggaaaagacagtaatttgaaaacgttcaaatgccaacatttttttcacatttaaaatcagtaaaataattattcttagggcaagacaaaatgggtaaaaatgactcatatatatttgcaggactacgggagtcataataaagcaaaacatttttttctgtatgtccagtgttagatttataaaatcaaagtcatacaaagactgatgtttaagcacattaatcttctattataatgtttagacctctcttagcttggctttaattgtaaaatcacaggccttgaagagagaataattaactctattactgcagcaaccacttaaagatctaaatattttggagtgttctatttgaaaattagagggagaactagtcactacaaaaccatctacagatctttgtgttctttttattctttctcctcaacatgtagtttgttgcatttgtaagggagagaaataaaaatatgtttttgggcataaattttaagatttttaaagcctgttcttttcattctgtcttcttcagagtggtctgctgactgatgaggcaaaacatttgtacccttggacatatctcaaaataataagagctatctatgacaaacccacaaccaatatcatactgaatgggcaaaaactggaagcattccctttgaaaactggcacaagacaggggtgccctctctcaccactcctattcaacatagtgttggaagttctggccagggcaattaggcaggagaaggaaataaagggtattcaattaggaaaagaggaagtcaaattgtccctgtttgcagatgacatgatagtatatctagaaaacctcattgtctcagcccaaaatctccttaagctgataagcaacttcagcaaagtctcaggatacaaaatcaatgtacaaaaatcacaagcattcttatacaccaataacagagaaacagagagccaaatcatgagtgaactcccattcacaattgcttcaaagagaataaaatacctaggaatccaccttacaagggacatgaaggacctcttcaaggagaactacaaaccactgctcaatgaaataaaggaggatacaaagaaatggaagaacattccatgctcatgggtaggaagaatcaatatcgtgaaaatggccatactgcccaaggtaatttagagattcaatgccatccccatgaagctaccaatgactttcttcacagaattggaaaaaactactttaaagttcatatggaatcaaaaaaaagaccacgtcgccaagtcaatcctaagccaaaagaacaaagctggaggcatcacgttacctgacttcaaactatactacaaggctacagtgaccaaaacagcatggtactggtaccaaaacaaagatatagatcaatggaacagaacagagccctcagaaataatgccacctatctacaactatctgatctttgacaaacctgagaaaaacaagcaatggggaaaggattctctatttaataaatggtgttgggaaaactggctagccatatgtagaaagctgaaactggatcccttcctcacaccttatacaaaaattaattcaagatggattaaagacttaaacgttagacctaaaaccataaaaaccctagaagaaaacctaggcattaccattcaggacctaggcatgggcaaggacttcatgtctaaaacaccaaaagcaatgagcaacaaaagccaaaattgacaaatgggatctaattaaactaaagagcttctgcacagcaaaagaaactaccatcagagtgaacaggcagcctacaaaacaggagaaaatttttgcaacctactcatctgacaaagggctaatatccagaatctacaatgaactcaaacaaatttacaagaaaaaaacaaccccatcaaaaagtgggtgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaccacttttacaccattggtgggactgtaaactagttgaacccttgtggaagtcagtgtggcggttcctcagggatctagaactagaaataccatttgacccagccatcccattactgggtatatacccaaaggactataaatcatgctgctataaagacacatgcacatgtatgtttattgcagcactattcaccatagcaaagacttggaaccaacccaaatgtccaacaatgatagactggattaagaaaatgtggcacatatacaccatggaatactatgcagccataaaaaatgatgagttcatgtcctttgtagggacatggatgaaactggaaatcatcattctcagtaaactatcgcaagaacaaaaaaccaaacaccgcatattctcactcataggtgggaattgaacaaagagatcacatggacacaggaaggggaacatcacactctgaggactgttgtggggtgtgggggagggggagggatagctttaggagatacacctaatgctaaatgatgagttaatgggtgcagcacaccagcatggcacatgtatacatatagtaactaacctgcacattgtgcacatgtaccctaaaacttaaagtataataataaaaaagaaaagcaacatttgtacccttgtagttttcttaaaccacaaatccaaattccaatcctagaatgtaactccaggatatgaaagatgggaaagaataatattacagtgtaaaatttgaagaaaactaagagaggaattttcatacttcactaaattctcacatctagtagttctgggtcagtgcccttattgcccttacctgacatttaaggcatatattgtgcatctttgtaagtaaatctgtgtggatacaatatagctttttgaatagatgttgattttggtttctgaataaaagtttctcttgtgatgaacctcacagtggcaaaatgtagatatgagaaggagaaaaccatttcttgagtaaaaatggtaaaaaaaaattttttttttgatctcacggcagcaaacttccaaaggcctttgatgtttgccattttgttgtgatagttaactaatctataatgtttgggactattgagttttgtgatttgacatttgttgtattggaatctgatctgtaaactagtagcatggcttgatgtagagctttgactaaagagactgagagaatgaagactaggaaatgaatttttactatctcttctcaaatgtttgtctaaaattagtcaagaacttcatttcattaaaaacgttaaagtttttttatttatatatgacctccaaaaatgattgaatattttttgaatacaaattctgtgccagtcagcacaccagctttttacatgattatctcatttaatccttaacacaacctcatggaatagatgttatcttcatttacagataaggaacattgggttcagagagagaagtattttgttcaagaccattttttcagctggtaaatacatgacagaggtaggactcaaaattcaggttttgtctgattccaaagcctgtgtgcttagtcactattataaaaacaaactcatagttcttgagtgagggaattatttaaggcttaagttacatttaccttttagtttaaaagacagtatatgtagtgactgtgtatcatgatgatccgtggtactgattattgaaatcattccacagaggtaggcatgtgcaggttgttgaattgtactattatagatcaattgtgcctggcactgttaacattttgaactgggtaattaatttgttctggaggactgtcctgtgtaccataggatgtttagcagcatctctggctacactcactagatgcgtataccactcccttgtgacaatgaaaaattgtcacgactttcagaaaaatcatcatccttctatctccaacagaagagtgaactcatgtttaacttcatgtaggtacagatgggatatttatcaatatgtatatagtacatagattaatagacacacatatttccttgttctgtcagctgacaaggtctagaagcagtgactgctcagtagcagtaagcagaccttacattcaaatcttggtttctaatattctccaacacaaggaaccaggactccttttagaaatggcagattctaggactgggttggaaaaaactacaagatgagcctggagcattttgtagtgccagaaactaaggaagttctcacaaaaaaaaaaaaaaaaaaaaaaaagacaaaaatcccccacaattataagagtatgccaaagggacacagaaactaacaggagagctctcaactgccaaatctggaataatttatgcaaaaaaaataaatagaatagtattgcattataacccaaagtataaaacaaatatccatgagcccatattgatataaataaatgatctcataaattaataaattgaagtgaagtagacaaatctcctgtgaggaattccaaataatttatgtaactacctgcccccaaggtgtgggacataactccccactccttaggtatgagctacccatagtgacttccttccaaagagcacaatcagtataggagagggaaaaataatgctccagtggagaaatctgatgaatactaccttagccaggtatttaaagttaacttcagcagtgataaatcatattgatagtgtgtgtatccttaacatgaagtaataagaatggcactttaccttactcgtcttcctctcaaaaacacataaccccagtctcatcgtgagaaaaacatgagacaaactacaattgaaggatattctacagaatacctgtttactactcctcaaaattttcaaggtcatcaaaaacaaggaaagtctaagaaactgtcacagataagggaagcctaaggaaatatgacaagtaaatgtaatgtggtattctggatgcgatcctggaaaaggggaaaaaaaactttaggtaaaaaattaggaaatttgaataaaatataaactttagtcaataatgtatcaatattggttcattaattgtgaaaaatataccatagtaatataatatattgataatagggggaattggtgtagtatatgggaactctatactatctttacgatttttctgtaaatctaaaacttttctaaaataaaagttttatttattttttttaaaaaggcctcaaaacattgccatatgtctctagggagcaaaatttcacctagttgagaaaatcaccattatagttaataccatagagaaaaaaagtatatttcatttttgtttctgttgagtccctagtggagaaataacattaatggaaatgcctaggatacctagtaggcacaaaggtgcaaagtacatatttacttaccttttctaatctctctccccttcccccttaaaattttagtgtccttgagggttttatatttttgtttttcttctcattctggtagctgtcttggattacctcatttgtgcctgtagcttcacatatcatccatatgttgatactaccaattcaaaatctttaggctgatcttagcttctaagtctagcttcagagtaagcatctatctatacttttatgtcccataacatgtcaaattcactagatttgagtcacaaaacctgatatctcctgcattctctgtcttgttccaccaactgaatatgtgggagtcatcctagattccctctaccttaaggcctgaattattgtaccctctttctctcactatgtcttccacatctatgggtttaaaacagaaatttgatcctcctaataccctttctcttaatcttataatggttcctcattgcatgtaagaaacttttttctccactgtcatgtacttcaatatctctaaaattgaccccttcctgttttgagcccctgaatctattttactggtttctgtggtaatacaaataacacaccactgacattgctgacctgtctccccttctactccacctaagctcctagagtgcaaagagtctatctttctgttcccatggtggttcatttatgatgactgaatgagtgaatgtggtttcagatttatggttatagattttattcagtgtgttcaacttgactggtttcctgtgttttgatatttctctgagtatggctttataaattcaatagtagtaatgagatgttttttatttatattagcagtggctttccattgaatattatgatttacctcatacttagttccttatatacattttaggagttgggaaaagcaaggtagttaaaatcatatcagaaaggaaccttactgttttttttgtgtctacatatagtacaataaaagcataattttagtatctttaatgtagatgtttgattagatattgaaacctttcaactataattagattaacagatctcctgctccatcctcattcccatttattagttgcttcctttcagactgtgatttaaagtttgagtgatgcgcctattctttctatagctaacagaattgttccaaagtgcagtgcagctgctactgaagctccttaggtcaatacatttttctgtaatagaaaaacatgtgtattgtgttttgtctccatagggatcttaaatctaatccatttaatttaaaataattttatttatctagaatgttacttaatattttgtataaaatatgcttattctaagaaaatgtttaagagttcttgtcagtgattattttaaaatgaaaacaggtaatgcaagaggcagctggacaatttttggatatatattgtctccaagttatatttcttcagaggaatgaataacaagtttgtttcccccgttactacgaactacacattatttttggagggaaataaaagggggtactgatgctttctgacatcaccctaattctctctatgaaaacagaaaccaaagcctcaagaatttgggctattaaaatgtaatatttgagctccagaaacctgttcttagaagtatgccgattgggatttatgtgaacttgggggtgggggaagaggggtggaaatgagatttcttaagaataattccattacttttgaggctgagacctagttcatagcttcaaagtatgattgggtttctcataattaattatctttttgctttcttgccccatgagggaagtctatagtaactactggatagaagtaattattgtaaaacatagttcaaagtcaaaatcttaatgactcctattaaatttctttttgatatgactttttatggaaatctgttaaatgtttgataattttcattatcccaaaataatgagactattatctgatatggcatactgtgtcagaggtcttcaagaccacttccaagtgtggtgatttgttaggataactcagagggctcagtgcatagtcctactaatagctttgatttatagcaacaaaaggaaaaggcaaatggtgcaaagaccaaggaatccaggctcaagctcccagtggagtcacacaggatgcccttaactcctccagtattgagttgtgacaacacatatgaaatgtcatatgccagggaagctcattagtgactcagtggccaggatttttatggaggcttgtcacatgggcagccttagcctagcacataccagatttccagactcccaaagaaaagtaaaccatattgtttgcacaatttaggcaaaatgagatattcttatcagggaatagtaggaactctcccaaaatccagaatcccaggggctagccaagggctaatcttgcaaggaagcttttctaaggatagcatctcagccctgttttattgtcttttcactgcatgtgcaatgtaacttgaatgcttataggtaaagtttgtctatcataattactgcagttttggaaggtggtcatacatccatgcctgtttgtgatggctaatatccatagtttgaaataaatataaacatggtcagttcagacttcaacacatcaagcatgttaacttttggaacagatgctatttttttttttaaatagaaataaaaaactgcatgttacaaaatgatcacaataggaatgaatatattgagactttttttttttagttcttcctgtgtaagttccataaatgtgtttaaattcagcaaacatttgagtgccactgtatgcctatttctgttctagatactagggacatagaaatgaatcaggcatgattcctgccatgaagaagcccatattctaagaaagatgacaggaatgtaaataaatatatgtttatagattagtataaggaacattattttgtcaaattgtattttttaagagattttaaaataagcttacttatactgctatttatgtgtcagtgtatattccacggacactgctatgtaatcttagggcttttttttaaaaaaaattttagtctcctgttttcttactttctttcttcttcttttttttatgagatggagtctcactctgtcacctaggctagagtacaatggtgcaatcagctcaccacaacttcggtctcctcagttcaagtgattctcctgactcagcctcccaagtagctgggattacaggcgtaagccaccacaagtggctaatttttatctttttagtagaggtggggtttcaccatgttggccagctggtctcgaactcctgacctcaggtgatccacccaccacagcctcccaaagtgctgggattacaggtgtgagccatcgcacctggcatagtgtcctgttttcttcaactctcttgatttttgtgctagagaaagtgagagagggcatgcttaattataaagtggtttatcacagtaagtcactgtgctggaacctatttaggctctccctacatcagccatcacaaacattttagtaactgcctttaagaaaaattttgccatagtgctattcattttttttttttttttgagacaaagtctcgctctatcacccaggctggagtgcagtggctcaatctcggctcactgcaacctccgcctcccgggttcaagcgattctcctgcctcagcctctgagtagctgggattacaggtgcccaccaccacactcagctaatttttatatttttagtagagacagggtttcaccatgttggccaggctggtcttgaacttctgacctcaagtgatccacctggctaggcctcccagagagctgggattacaggtgtgagccaccacgcctggccagttagtgctgtttttttttgttttttgttttttgtttttaagatggggacttgctctgtcgcccaggctggagtgtagtggcgtgatctcagctcactcagctctgccttccgggttcatgccattctcctgcctcagcctcctgagtaactgggactacaggtgcccgccaccacgcccagctaatttttgtgtgtttttagtagagacggggtttcaccatgttagccaggatggtctcgatctcctgacctcgtgatccacctgcctcggcctcccaaagtgctgggattataggtgtgagccactgcacccagccacagttagtgctattcttaatgtccagtacttgtagtagtcatattttgaattttatataaagctttatacaaaaagaaatcaattatcataatttcctgtttcccccatgcaatctgcctttttattcctgcctcttcttctgaaataactgaattattagtcagttttgctttctttcatttctccttttgatatgacttccttaatataatgagcttggaatttgctttaggtggttgttcagtttatcttctaatcatgtatcagagtcttctatcatgcccacagctccacaaaataactcaagaacctgagctctgggtgtggagctttactaactcttcttcccctttgctttaaatttttacactaacacgtgtattttttggtctgtcgtatatttatttatttcttttttgagacagggtctcactctgtcacccaggcaagtgcagtggcacgatctctattcactgcaacctctgactcccagtttcaagtgagtcttatgcctcaggctcccaagtagctgggattacaggcctgcgccacatgcccagctaatttttgtatttttagtggagatgggatttcaccatgttggccaggctggccttgaactcctggcctcaagtgacctgcctgcctcaatctcccaaagtgctatgattacaggcatgagccattgcacctggcctgtcatatacttttttataattattcatgtgcttatctttgtcttctgtcctctcagacgctgtgcttttttaccacaatttatacaaccagctgtgtgactttgggtaagttacttaacctcttaatacctctggctactcacctataaaacagagataataatactcacctcacagggaccttgtaaggattgcattaatatatgtaaatatcttagaatgatgtctccagcccacttgataaatgttatcttccccaactttttttaaaaattcaaaccttcaaaaatggtaagagtgaataagtatccacataccctttgcttgaactaattttttactttatgccaaattttccttatttctgtaagtgtgtgtgtaatttttttaaacgaaactacttgaaggtaaactgcatatattatgatacttcagcacatatctactaagagtaaggacattttcctatacaagcacacccaggaaatgtaagaaagagacaatgaaagtatttactatgcagtctgatatggtttggctgtgtccccagcaaaatctcatcttgaaatgtaactactacaattcccatgtgttgtgggaggaaattgaatcatgggagtggttctttcccatgttcttctcatgatagtgaataagtctcacgagatctgatggttttataaggggaagtttccctgcacaagctctcttttcttttctgccaccatgtgagacgtgcctttcaccttccgccgtgactgtgaggcctccccagccacgtggaactgtaagttcattaaatctctttcttttgtaaattgcccagtctctggtatgtctttatcaggagcatcaaaatggactaatacagtaaattgatactggtagattggggcactgctgaaaagataaccaaaaatgtggaagtgacgttggaacttggtagaggctggaacagtttggagagctcagaagaagacaggaaaatctgggaaagtttgggactccctagagacttgttgaatggctttgaccgaaatgctggtaatgatatggacactgaaatataggctgaggtggtctcagatggaaatgaggaacttgttgggaactggagcaaaggtgactcttgttatgttttagcaaagagactggcagcattttgcccctgccctagagatttgtggtactttgaacttaagagaaatgatttagtgtatctggtggaagaaatctctaagtagtaaagcattcaaggggtgacttgggtgctattaaaggcaatcagttttaaaagggaaacagaacataaaagtttggaaaatttgcagcctgacaatgtgatagaaaagaaaatcccattttctgaggagaaattcaagccagcagcagaaatttgcataagtaacgaggagccaaatgttaatccccaagtcagtggggaaaatgtctctagggcatgtcagagaccattgcggcagccccttccatcacaggcctggagaccgaggaggaaaaaattgttcagtgggctgggccgggatccctctgctgtgtgcagtctagggacttggtgccctgtgtcccagccactccagctgtgactaaaaggggccaaggtacagctcgggccatggcttcagaggttgcaggccctaagctctggcagtttccatgtggtgttgagcctgcaggtgcatagaagtcaagaattgagatttggaaacctctgcctagatttcagaggatttatggaaatgcttggatgtccaggcagaagtttgctgcggggatggggcactcatggagaacctttgctaaggcagtgccaaagcaaaatgtggggtgggtatgcccacagagagtccccactggggtgctgcctcgtggagatgtgagaagagggccaccatcctccagaccccagaatggtagatccacagacagcttgcaccagaaaagctgcagacactcaacaccagcccatgaaaacagccaggaaggaggctgtaccctgcaaagccacagggacagagctgcccaagaccatgggaacccacctctggcatcagcatgacctggatgtgagacatggagtctaaggggataattttggagctttaagatttgactgccctactagatttcggacttgcatggggtctttagcccctttgtttagccaatttctcccatttggaatgggtgtatttatccaatgcctgtatccccattgtgtctaggaagttactaacttgcttttgattttgcaggctcataggcagaagggacttgccttgtctcagttgagacatttgactgaacttttgagttaatgctgaaatgagttaagactttggggaactgttagaagacatgattggttttgaaatgtgaagagatgagatttgggagggaccctgggcagaatgatatggtttggctgtgttcccacccaaatctcatcttgaattgtaactgctacaattcccacatgttgtgggagagaccccaggggaggaaattgaatcatgggggtgggtctttcccatgctattttcatgatagtgagtaagtcttatgagatccgatggttttataaaggggagttttcttgcacaagctctcttctcttgtctgccactgtgtgagacatgcctttcaccttccaccatgattgtgaggccttcccagccatgtggaactgtgagtccattaaacctctttcttttgttaaattgtccagtctcaggttatgtctttatcagcaacatgaaaacggactaatacacaggctgtgttcacaatttcccaattgttcctaaaatttcctttatagctttttcctttttttattctttctctctctgtttaaaaacgtctaggaactaaacaagaatcacatttgctttagttgtcctgactcttcagtctgttaatttagaccagtcttccttccttttttcctgtcttcttgtgactttgacattttagaagactatagggcagtagcttgctttgtaacatgttcttttgaaaactgcacatactgattgaaagataacagactttgttaaattatatttcctctctgtggtcttcattgaactaaataattaaatgatagtaaaagtagccttcatttaatagttaaattatttaactattatatgaaataatttaactattaaatgaaggctacattttattatttaattatttaataactaatgtggtttaattaattaaactttaaagtttttagaagataaataaataatggagataatttgggttatgtgaaagatcattaaaaataaaatacatattggccaggtatgtaatcccagaacttcgggaggctgaggcaggcagatcacgaggtcaggagattgagaccatcctggccaacatggtgaaaccccgtctctagtaaaagtacaaaaattagctggatgtggtggcgcatgcctgtaatccaagttactcaggaggctgaggcaggagaatcgcttgaacttgggaggcggagattgcagtgagccaagattgcaccactgcactctagcctggtgacagagtgagactccatctcaaaaaaacaaaacaaaacaaaacaaacatattttgagtagaatattccaaaagattaggtttataaagaaaaaaattagaccaaaaaagttgttttatttgaaaaaggctttaaaaatatttcagtctcattttattaattctttaatatttattgagctcttgctaagttgttcctgttctcctaatgtttgaaatccagggagtgaggcaagctgttaggaaagtgtagtacagtgtgataaggcatgtgggtatatgtgatgaggagcttacagagtcctaggggagcaaataagaagggcagctaacttagaactgggagattagagagacctctccaaagatatagtatctgtgtatagacatattaatgtaggtataaaggtattatgagacaaccagacaaggggttaggggaagagtgttccagagaaaaggaacatcacatcccaagctctacgtatgagagagagagaacctaatatttgaggaatgtcagaatgacggtgggtatgcagtatggagaaggaactacagggtggcaggagaagaggctgaaagggaatgctggaggtcttataaaccacattaagggatttgaaggctactcttagctcaattggaaggttacctacaaaagtagaagtatgatataagcagatttgtactttaggaaaattggaaaacaaagctggtggcagggagtccagttaggaagctgttggctcaatcaggctaaagatgttggtgacccggattaaggtagtagtcattgaaatggagagaactgaatgagtttgagaaatatttgggagatggtatcaacagtatttggtgattgaagaagaggtataacatattaattaagaaaaagactgtagagcccagacatctgggttcaagtcctaagtctgtcacttagtagctttgtaaatttgggtcagttattaaacctccctatgcctcattctccccatctgtaaaatgggaagaaaaacagtactcattttataggattattgtgagaactaaaagaattaatatatgtacagaatttagaacaggtgccaggtacatagtaagtatcatataagtgttctataatagttattgttgcaattgttaatattattattactgatttgatatgtcagtgagggggagaaaaagagccaaggctaactcctagatttttaaaatggcagttgaggtgaattgtggcagattttatgtgtgtggcgggggcgggcagggaggaggtctgatgcattcacatttggatttgctgagtttgagaggcttttccagttggcatcgctcaataggcacatgaatttggaagtagggagaaagagttgaggatatcagtttgaaaattactagaatataggtgataattaagctgtggaaatagaatgaattcacccaaatgaagaactagttaaatagggagaaaggcatataaaagattgtgttatctttaagaatttattatttaggccagaagccaaagtataaaacttggtgccaaatggaaagtttagaaaactttcagcattcaatacaacttcatttaaattaggttggtcttcagaggatattgaggtgagtaaaatgggcagctagatgaaagaaaatcattcatctattgaggaaactgcagagaagtcactttgctaacacagggaagatgttgctgattattttctgttttggatctgacttaaggaaaaaagataaaagattcattcttaattggcagaatagcaaagaatgagttaagtctttctataaattatttgtcttaagtacctattgctagaattagttaatattgtatttactaaggaattctatattttttcaactattatgaaaattttcaagcatacagaaaattagaaagaacaggacaatgaatacccatataaccaccacttagattccatacccacctatctataagtatgtgtgtgtatgcgtacatgtctgtgtttagtgaaaccatttcaaagtaaattgcaaattttatgacactttaatcctaaaatatttagcatgtattccatattatacctcacaacaccactatcacatctaagaaaattgacagtaatatcttaatattagctactatccagtttatagtcaaattttcccagttatcacaaaaatattttttatggcttttttttcccttcctaaacaggatccaactgaagttgacatattgcctttaggtgttatacctctttagtctcttttgtttgaaaatcttcacctcccccaaccttttttttttttttttgaaaggaggagactttttaagagagcagaatgttctaaattctaaatttgtctgattgcttcttcatggtatcatttgtcttgttcatctatcctttgtaattcctataaactggaatgtaaaccaagttgattctattcagattaaatgttttggcaaaaatacttcatagatgacactgtaaacttcatattgtattgcatcaaatggctatcagattagcaataataagtttgatcttttctgtgtaataaaatacttttctcctttgagattagcaggaaattggtgggaataatttcatactaaatggcttagcatttattgatgactgaatcagttatttcatcgggagttgctaattctatcgttccttgtacattgttagctggcattcttaggtaaataagaattttgcacctggaaatgaacaacataattacttatttgctttatcctacagtacacaaaaataggtttaaaatgacaaaacccagtgttaatactataagcataatgtgaggttcaatatttttaatagtttttattgtccttagaatatatgccaataagaatgtaagtcagaatactatgttcaaaagtgacttgaaatattttttgttctcatgtggttatgttactgatttgacaagcaattaagttcatttgtttctacttgttttcggtcaaagtttgcttatttagatcttatatttagttttattctcttgaatttataaaacttttgttggttcagaagtcacactatattataaagtatagttggagaagtttggcttttattttgtacatctaccctctacctctgtccttttaccaccctgtcataggtaaacatttttattcatttctagtttagcctcctagtgtgtttctatgtgttgtgatataactgtgtaactgtccttgttaattagcgttgctataatgaaaattccataaactgagtggttcaaacaacaaacatttatttctcacagttctggaggctgggaagtactaggttgaaggtgccagcagatttgatgcctgatgagggctcaattcctagttcaaagatgtccatctttttgctgtgtccttatgaggcagaaggttaaggagctctctgggttctcttttattggacgctgttcccattgatgcaggctctgtcctcatgatctaatcacctatcaaaggccccacctcctcataccattacactgggggttaggtgtcagcatatgattttgggggaacataaatatttagtctgtggcagtactacaactctaactatccttattttttcttctatactggatgtatcatcttgtactccatagaggcatgcctagtatatttgatgcctaaagcagataactttttaatatatatctctcctatatgacaaaattattttcaaaaataaccatgaaataaaacaaaatataataatgggtagaaatgagatataaacattatattttattttattgaatgatgaatatataatcatgccaataaaaataaattaaaaataaaataaatattacagtacagaaaatgtttattaaaatattttcaccagaaaattcatcttaagtttttctatttgtttttttaaaaaacttctgaaagtttttctttttctggaaaatgcagagaaaatgactgtgtgatagtgggcattgatgctatttgacccactagtttataactgtgcattcaaataaacagtgccatttggtttcttctagtaatgtaaaagcagcatcttttgttgtttcccttagcattcttcacatttttgttcttttctcaatataaatgtccatttcctcacattttatttttgagtaatgaccatagccacagtttctatgtactgttctttaaataacagttttaaagctttatgttttattgtccattgttgaaagttgattccggctgtctgcaaacatttttgtgtctgattagctcatctaaaacttcctaccagaaaggaaaaaaaaaaaaaagacaacttaacgcaggaacagaaaaccgaatgttgtatgttctcctaagtgggagctaaacaagaatacatggacacaaacgggaacaacagacaccagggcctatttgagggtagagggtgggaggagggagaggattaaaaaaaatacctgttgggcactatgcttattacctgggtgaccaaataatttgtacaccaagcccccatgacacgcacttatataacaatactgcacatgtacccagaaacctaaaataaaagttaaaaaaaaaaaagacaacttagaaaagagaaacaaggccaggtgcagcggccttatgcctgtaatcccagcactttcggaggctgaggcaggaggattgcttgagcccaggagttcaagaccagcctgggcaacatagtgaaaccctatctctaaaaaaatacaaaaataagccctggtggtgtgcacctgtagtcccagctactcgcgaagctgaggtgggaggattgcttgagcctagggggtcgaggctgccgtaagctgtgattgtactactgcactccagcctgggcagcagagcaagcccctgtctcaaaaaaagaaaaggaaaggaaagagaaaaagagaaacagcatacactgatcattatttatttggaatatattatttaaatgcagaaatatatggtgtcataggggctagagacataaactgtactcaaaggaaacttgaataattttgaaacattacaaaattaacttctgaataaatgtaactgagtccatgtgcatcagaggctaaactgtgagttctccactttctttttttttaagttaattttcatatataaatcagtgtttattgagaaataagtaataaaaatctgctaatttaaagcttacatacaggttattaaaacttaacagtcactggaacaattatttagaatttagaacacaaattctttttcagggagtatttttatcactgacattgtttagaattgctggcacttgatgataaaaagcagaataatttttagttaggtttaatttttaagttctctatgtagaatgcacccccttgttgtgggcctcaagggtgatctgcttctaccaccctacctttggtatgccactgtatccactagcaaagtatgagactatctgtttcttcccaacctcaccaacagagtgttgttgaatgtttcatcagtctgatggtgagaaatcatattgttttaattagcattcatcttatgagtgaaggcttttataagtttaaaggtcgtgcatttctttttctataaaatgcctagtcatttattttgccatttgttttggtggtagtttttccccgactctatgtttgaacataagtggtattgcggggggtgggggtcgggtggggggctggggcggggacagggtacctttctcgaaaccttagtactcaacatgatacacaacagaaatcaccatgtctccctttaaggtggcttatgcatactgcagccacactaaggaactaaaacaacttcatatgtatgagcctaggaaactgttgaagtagagcttttcaaattggactcacagtttcatctgtttttatacattggaatttcttacacagtttcttttaagatataattcagttcttaagtctctgaatcactgctataaagtgagaacaaacatcagtggttcttttaaattttataatataccataatacaataagagctacataattagaaattagtaatttaaccaataaaatcagttaaattggtttcttcactgaattgagttaggcaatttaattaaaataattatcacataaatatagccctactgcttaaagactatttatactttgctaagaaagaaaaattgtatattcattttatagagtcaaatatgaatgtttgtattgcagttattaaacttttatattatatataaacagcttcccagaaacagaattgaacatgaaattttatctccatgtctgcaaattccctttcagtcagtatttatatatatattatctttgtctttatagtgttacctgcatgtttgtattggaccttttctacttttttttttaagttgtaaaaatggtaacaacatttaagacaaaagtgtaaagacagagcatagccactcataatcttatcactaacagctttttaattgtcagttgtcttattttttaatgtctcttctaaattgtcacatctgtttctttaaaaatcctgatctctaagaataatttctcctcagtggcactttttgcctactggtccctcttttaaatacgatagtattcttcaatagcaacaaaagtgtatttggttttaattttgaatttaaaatttaacaaagtatctcgtgtttactgaggttaaggtacttgtgaattatttattagagagcttggaaatgttaattttaagtgtatgtattgtaaatctgtctcatcatgtcaaaaacaaggtaatagaatcatgtaatatatgaagatgtatgttattaaagagctacaaagaattgatgttagtgcttacttgaacttacaacagactttttccaactgaattgagattaatttacatctctctagaaagcagtaacttctgacatccattcattttgaccatgaaaaataaggtggtgtgtggattgtacctctcccctgtatctattggtctcgttacctgtgtgccttgttttttctcatgtgacacctgtttattttttcatcacagtagctaaataacgtagtattagtatttgcctacagcagctctaagttatatggttttcttttagctttagtcatagacctccggattacttgtttcgtgtctctctgaagaaaaaaataaaagaaaatgtggtacatatacaccatggaatactatgcagccataaaatgaacaaaatcatgtcctttgcagcaacttcagtgcagctgtaggccattacattaaatcaattaacacaacaacagataaccaaatccacatgttttcatttataaatggtagctaaacattgagtacacatggatagaaagaggagagcaatagaccctggggtctccttcagggtggagggtgggaggagagtgagagtcaaaaaactacttattgggtagtatgctcactgtctgggtgacaagatcatttgtataccatactccagtgtcactcaatttacccatgtaacaaacctgcacgtgtatcccccgaacctaaagtaaaagttgaaaaataaagataaaaagatagatgaaatttagctatatatctattaatttaaaaccaccattaccaccacaactcagaaagaccttgttgccaagcgaacggaatacagataacacaccgtgtctttcatcacagagttttcatcttaatctcccttgatttggactgtttaaatatcttttctttttctttttttttttttttggaatcagattccccgtccccatagctaaagaatttaaatttgtctttatgatgctgttgtttttacctttttcttgggacacggtgaatattaatattctcatttcaatgtaatttctttttaatttttgagttttcttcaactgtgcttcttgtttattaaacatttagttcattctcttttctcctgcagggacacctataatttgaagtttgaatcacagcacttcccctgcacatctgtgagcattcattcacttcacgtctcagctaatttcttatgtttagtatgtttcttgactctgcctcctatttcaccaatacaattttctgctgcgctgattcttctaatgctgcttctactgccagtattaattggtttgtggctaaatttatcctgtgctgctgttagtgccctccaactgttctgcttttcccatagtccacattgttgccagaatgatccatctaaaatacaagtctggctatgtcatgcatcctggtaaaatatttagtgacttcaccacagagtaatgctctaatcctttaaggtcatgagttagatccttctttcatctgagcctcccgcctatcactctagtcatataatcccttgcggccttgcctttccttccatgccattcagcatgccctttctcctgcctggaatgcccactgtgctccctctatctatcctctccattcattcttccagtctatgttgcctggcttcccctaccagtcacaattattttctcttgggtacatactcctatgtaccttgtacatgcttcttaactggcttttgtagttatttgtttagactggtttatgatactataacactggggtgaccattatgacaccaaagacaggtattactttgtgatttttatatcccccatgcctagcatagtgcttggtattttgttttattacccttctgtcctcttcgttttatttattttaagggagaaagtaatgatcacctctatcatgtgatttttttttcttttttatgggaagtatttttattggaatcagactgtttaattgtttttctcctgtccatgttttcttgtacataatttactaatccctaagatgtggtcttaacagtaaattgccttaaatcaccatatggtattcagtcactgggtcagggtagaggaaccagttctgtaagtggcctgcaaaaggcccagttagtattcatttcagtaaccaaattacaggcttaagtcaaccaggactgacttctctagcttaattgtttggtctgaagcctgggatggtgctcagctttcacatgtgttcctagttatgcagctctgaaatttgaaagcaagctgtactcggccagggtggtcttattctcttgtttttattgtttgcctcaaagattatatttgctctaattcttaagcacttaaaagaataggggaaaaaacagaagctttatagatttctaaaaaatggtatacttttgttgttcgcttaaaaaaaaaacctctcaatagaaagttatgaagaggaggataaaaattcttcattgtcttgccactgagaaataagcacattttagaatatgttttgcatacacatataagaaacatgtaccaattttgtaaatattgtatactaaatgctattctgcaccttcctcttttttttaactcaatatatttaaacattataaatcagtagttgaagacacgtttcattattaatgatgtactcatcagttccctatagttggacacatttttttacatttgtatttgaatattaccttagtagatctttttctaagaggatatgcaagtatatgttaatagatattgccataatgcctttcagaaacgttgtgcaactgtatgccctcattaatagtgcatgaaaatacttattaccgcacatctctttcaaagctagattattgtcagttactctctgtgaggtaaagtcttccaatttccagccctaaattcagagctcttctctgaattccacatagttatatccaacaacctacttgatatttctacaaggtgtccgtctcaccaacatatcaaaacaacatgccccaatccaacctgatttcctgcctcaattctgaaacctgttcttctcctttctatttttctttaaatagaacttaaatttacctggtttctcaaatgagaaacctggagtcattattattttttgtctctgcctctctccctgaatcttcctgtcaaatgtaccaccaactattatggcttctacccacaatcccatgtatagccaaatacaagaagagcctgttcttaagctgtccacaattactagaagacatgtgtttttttttttttttaaaaaaatttgattagacagtatgaatctaactgttagggatataatcaaatttctacttctaatatttaatttaattatacatgtatttaaactcacaatttagagatacagggtttgccactgtgtcatacaaaaattttgttggtgctttttcaacactggaatgagtcatctaatacagttttccagatcatctcctcctcccttccatctaagttgtttgagataatgtattttttgaatctgtgtataatgctgtctcagttccaagtacaattagggcagaatttttccccctactttttctgttggcatatattcatgatcctgttacctaagcatggactgaattgcttttttcaaatgatcactgaaatattgcttgatggtgacatctaacacacacagcagggaggtaatacgtcatggaataattactaaatcttcttactttgcttacttttttctttttttttttaccagttgtgtcaaattatctcttgaagcaattgttgttggttccagctaacatgactgttccagagagtactttgtgatttttcagaacaaaataatttgtatgtcagtctgtaatctgaaatattctaaggttcaaatataagatgatttcctcttctaaggatagtttttgatattgaaaaactcttcatatatatgggtttgtacagtgaatctcaaatccatctccttttctccttcactaccactgtaaatcaaaatcatctcttacctggacagtggccctcactgtttaattgcaggccccatagctattcttgcccccctgtacattctccacacaaagttacttttttaatatgccagtctaattttcttacttctttacataaagcccattagtgctatttcttgactaccttttcagtttaccttggtacaacttggctcttaccattagcacatgaagtcttcagcttgatatagatagcagatagcctctatttagctattaaaatgcctgcattggtagtagtgggtaaggagggagctagagccgagggaacattttggtagctttatctccgtttctctatgaatttttgtcttttgctcctaggcattgggaatttttgctttccctgttgggagcaggcatggtggcttcatttggctccctctgcttcagggtgaactcatggtgaattagaaggtactctgccacagctcatacactttttgtcatgtactattccactctcaagttactgtcgtctgcagctttgaagtaggtttgcctactgacatcacacctcccagttaagaaccttgtacagaagaaaaatggccaatgagtttggccagtgagttccaccttcagtcctgccgtgctttctgatagctcacgtaaactggggatgtcagtggaggccttccggatattttctattcagagtttgcaaaacgtgctgtccttatgagctagagagttgcttgtcagcttttggcattccctcagtgtagtccaaattgttttgtattttctggagttgataacgtttttaagagataataaattttttctttcatttttgattattttttctcattttctgtgttgaaaagagggatttttgtaaaagtgacttatattgtcatgttgcctagaagactcttccagttcttgaacagacattttacattttgaaggatcattttaaaaaatattttaaatgtgttattgattaaagagagattagaaatggaaattggaaatacttaaattattttgtttgttgaatgtatgttgactctctctggactcagattacttttgatgtataatagaattttggggatctttaaccatttactgcagaaaagttctgagggtcagtatatatttttaaaagctatcagagaaaagaaaactattaaattgttcctttcatattggttaattatatcagcctactgcctgaatccagaggttgaaattgtttacaataatgaagtctcttaaaacacactatgaattctctaattatcatcttttttgggtcaatattccctttcagctgtctctttattagctgttgtaatgaaatatcagtaacagatcttccacctcaagtcttggacattctgttgaagtgcataactttgatttgtaaagactactaaacccagttattatgttttcagtgaaaatgacagtgcacaatagatggttttgtacgctcctgtcaaaaggatgaagcatataatatgactcagttattggtgtgccagccaggcattggttatctggcattacgacaggtttgctaatgattcctgatgtgagcgtcacaaagaaaaaattgtaaatagcctcaggataacacttctaaaatgctgggttttttttaagtactaaatgttcataatcccataaaaagtttagaaaagaaaaggacccaattttgattatttactttttcactttttctactctgttctgctaggaaggtcccatcttactttgcccttcctgatatatgaccttttaaggggaggttgtggtgattttgttgtgtcttgtctagaatgatgatttccatcttatttttcaaacataggttttagttctttagtttatccgttgactgagagtttcagttaaaagagaaatgattgcaatttatcctaggaatggtgaaaataatatttattttgaagacagctgaccaaagaaaagcctacacaaatagtctcagctttcatgtagaacttggaagttttttgtcataatggtccactatgttaggcctccttttccattaatgacatttaaagggcacaatttttcacaatttggtttccagtttgtaaaactttttttttcattatagtaacatattttcactgcagaaaatttgaaaaacaaaagctatgaagaaaaatgtttttaaagaaaaaagtttatttaaggccggatgtggtggctcactcctgtaatcccagcactttgggaggccagggcgggtggatcatgaggtcaagagatcgagaccatcctggccaacatggtgaaaccccatctctactaaaaatacaaaaattagctgggcgtggtggtgtgcgtctgtagtcccagctgctcgggaggctgaggcaggagaattgcttgaacccgggaggtggaggttgcagtgagccaagatcacgccactgcactccagcctggtgacagagagagactccgtctcagaaaaaaaaaaaaaagaaaaagcaaaaagtttatttaaaatgcttttcaaaatcacaaggtaattacatcctttgataataccttaagtattgttaagtatttaagaatgagtttgttttatgtgtgtcgcttacattttttttaattaattaatttattattattatactttaagttttagggtacatgtgcacaatgtgcaggttagttacatatgtatacatgtgccatgccggtgcgctgcacccactaactcgtcatctagcattaggtatttgcatatattcagttatgtttaatttggattcataccaaatattttattttgtaacttgctttttttcatttaaaatatatcatgagcattggactgcattgtcatatattgaagcattacttttttttttttttttgagataggatctcattctgttccccatgctggagtgcagtggtgcgatcatggctcactgtagcttcgacctccctggcttaggtgatcctccctcttcaacctcccaggtagctaagactataggtgtgcaccacaacgcccagctaattttttgtatttttaaaatacagacagcattttacccatctctacaaaaaatagagatggtctcggactcctgggcttaagcgatccacccatctcagcttctcaaaagtgctggaattacaggtgtgagccaccatacctggccaaaacattacttttaatgatgttgcttagtgaaagggtttgtgtgtctttgaagtctacagtaaaagtatttttctaatatgaatttattggaaacactatcagtataacaatcacattatttaaaatgtcatttttgcacgtttaagacaagcgtttatttagcactatgctagatattttggaggatacagagacacacaaaacataatttctgacttcacacatgcttaagatccagtgagggaagcagacacgtacccactgttctgtggcaagaaccaatggggaggagagatgaaaagatgaccttcttagtgtggactccagagttctgcccacgtcttgttttcagagcaggtggacaagcggtcaatgtgcaggtcttttgctttaaccttatttatgtgtacacagcactgtagatttatgtgtacacagcactgtagagcactagttagagtagacacaaaactgaaaccactagataaaacaattgggtgtggaggttagaagggtagagctgggtgttgacagactggtgtagttgcctcagaagtgagaatatagatatagatgcaatagcattttcctctggggcaccacctctttttctttacatctcagatccctggccatgtgtctgacagttttttagagaaatgattgttatttgtaaatacatcatacacagaaacacttgcttttttaagcaaataaaaatcataaaaacaaaaaaaagtccacagcatgatgggttttagttatacataatttgaatataagggagcaattttgatgctgcattaatgtggaattctacatgtgataaacagtgttagacttttagaatatatatttttagtttggtagagctcatggattttccagatgtataggctgcttaagccaaagagttctttctctagctatgattataattcttctgattataaatgcattaaaaaataataaaggaaggatgaagtggaggaatgtaagaaataagaaggaaggggagagagaaaagaaaacctttctgggcatgtgtaaggaaaccagcaggcttgaccttcaaatgccagtgatatgtaggacccagggcaacagatgaaatctgaccaatacatttgtgatggccccttccaggaacctatggaaagtggacactcccattttaatgtttactattgccataattcgtaatatagacgaagaatgtgacctttgttagcaggagcctttcttgtgactgctgaggtggtggctctattatgtagaatataataacattgcttcattgctttagtctgtttcttcaaactgtaacttgaaaaactgactagttttaaaaatggaaatggctcaagagactccagagtatttaatgcttttcacacttgggactggagaggaatttaattatataaattattttaaaaatccattaagttcctgcttgcctgtaacgagcgtggcatacttagagaaatgtgtagatataaaccttctgagtttaaaaccttggatatattcttttaagtaggagacagactagaaataatgagaaagcatttgaacacagatgtggaatatagaggtgaccagaaagaatatgttgatagttgttagcttatgggaattgcaaagggttttagtgtcagacctgagttagtggatgttcttttaaattattgttacaaggttctgcgtaacctactggtctatggaactcttatctcagattgtgtggactcttcctcactttctaagagccagcaacactggatttctctcagttcctctaaccactgtgttcttccccagctcaagtaagtgctgtcgcatgtcttgtttcctctaccaacatttcccccactgccctttttgccttgctggctcctatttatctttcagatttcagctacaatggcacttagtgaagtcttcccataactcccagatttaggatctaagttgtaaattcccacaatactctgtacagtagtccccccctccttattcttgggggatatgtcccaagaccccccagtggatgccggaaaccatggattgtaccagatcctacatatactatgttttttgatctaataacccagacagctactaagatagctactgagtaactaatgtgtgggtagcatgtatggcatggatatagagatgatacagcaggacaaagggatgactcacatcccaggcgggatggaacaggacggtatgggagttgagttcattgcagcactcagaatggcatgcaatctaaaactcattaattgtttatgtctggaactttccatttaatactttcagaccaaggctgactgtgggtaactgaaaccgtggaagacaaaacgttagataaagaggaactcctgtacttctcttttataatgtttccacgtttgaaatttcttcttcaatgtttatcttccctgcaagactttaagttccctttgggctcactctcattcactgcgtttagccctaagtacctactcctcagaactcagaaatgactagactgtgtcatggaaaagtaggctgttatgaaacaggaaacctgtactctataagcttatgcaaaagaagaaattcatcaaaagggaccatgtctcttacacacacaggtacatacgcgtgtgcacacacacaaacacacagagaaagagagagggagagagagaaagaaacagggatattctaggacagcgcttacaatgtttacagtgtaggctctgaagacagattgactgtgttcacatcccaggtctgtcacttactagcagtgtaaccttggccaagttacttgacttctcaatactttagcttcttacctataaaatgggaataataataacacctacttcaaaggttatcatgaggagtgagttaaaacatatagcatatactataataaatataattaatatgtatataataatgataataattctaaaataacagccctagtcatcagtgtttccatttcttgttcttgtctcattcctatgcctcttccacagaaagaagtgtttttggcttttcctgctgtagacttgttatacccaatggtgccagaagataatcgattcaaatggttagcttagccttattttatatttcagtccagataccattttgtgaatatgttttaaaatgttaataaataaagaacaaaatttgatgaattgacatataaactataattaaaacctactttaaagactcatagagcttgctgctttaatgaagaattgaagaaattgatgaagaatttattttagtgttttgactgagccaaaataaaatcagtttcattgttgaagaaacacagtttaacataaacttgtagatagactattaaagagtgctgtatcagttaagtgagcactgtcttctaaaatttcatgtattcaaggatggagagggtcaaatgaatagttaaaaatacaaattaaggccaggcatggtggctcatgcctgtaatcccagccagcactttgggagtctgaggcaggcggatcacttgagctcaggagtttgacaccagtctgggcaacatgacaaaacactgtctctaccaaaaatacaaaaattaacctggcctggtggcgtgtgcctgtggtcccagctacttgggaggctgaggtgggaggattgctggagcccccgaggcggaggttgcagtgagccgagatcgcacctctgcattccagcctggttgacagagtgagaccccatctaaaaaaaaaaaaaaaaaaatttaaactgattaacttattctattttctaggtacacactaaatctataaaaactaaactaaatcaataaaaataaaccatggccttggcctttagatagctgacaatttaggtttaacaatgtatatggtatttttgaacagcttttgtgtcatagaatgaatatgttttactatgaaatgtatagatactgattatctagaaaagcattgtaaatacttttatttttacaaagaagtagacagtttgatttattattttttagggatccccttccttgagccagggagccagtctggcattaggctaatcttaccactttcatggaggcttcccttactgctatagatctcatgaggtagaagaagtaataagagggactgctattctgagtcctggtctaatggaaaaggactagtttgtaatattggttgtgtgttgatgtggttgtattgaacagtttattgggaaagtcaccaagttgtcttacagacatcattgtaaagaagagaactgaaacatggttatgcccatcctttgcctttaaggaaaacagatatttgcaagattatagcatctatggctgtgatttcaaggctagagagttctaaaagaaaaattattagaagaaattcttataggtgtacaaaatgccctgaacagctcaggtttcttaaaggatgtgcatgattaatagatgaaaggagcacataatcatcacacagttatacagtgctaagactttaagaaataaacatttaagaattttctcttcaaaggccaaaatttaaaaggaactaagatgcctcagagtgcacaaagagcttttaaggttgtgtttggagcaagagcaacaagagggaagagatagctcactgtctgaagaagatattcttaatgtctgtttacaggtaaaaatcagacctatacaattcttactttgcttctataatcttgcaatagcagaaatccttttcctatagtaaaaggtaaaacaaacaacctgaaacagaggaaattaaacaaacaaacaaaaaatatgagaagatggagtatcattcactttaaatgaatttaaattttcaatactgaaatgtattgcctcccaggagttgacggactcaggtataatcgtagggttattgtcacttttttttttttaacaaaatatagttttttgtttgtttgttttgttttgttttttttttacaaaatcactgagaatatggggtaaatacttggagacaagagagagacaaatgtcctagtttccaaaaaggaataaagtatattgcaaaaacccaagaccaattccctactttaaactgtggtaaaatttgaagagattgtaaaaaaatgaaatattgtgtttagaagagaatgggatgatcaccatgaatcaatatgaatttataagaataagacatgccaaaatgacctcattttttttttgctttatttttagttgtataattgctattggattagagaatagtaaagacatgttgtatcttgactttcgccaagtggttgacagtgtttccttaactatccttgtggaaacatgatgaaattagattgtaattagattgatttacagctgcttgcctggccattgccatgcccgcatgcccagcgtttagttaaataatagttactttatatactggttcctcacagagaactggtggtgaacattaatttgcatatattcagaaagtatggatttgtagttaacgagtttttttaaggatttgtatgttgaaacttgagttcctggatttattcatgattgaggtttctgttagggacttttttgcaaccaagctgtatttgtaagatatataaatctgtttttaatttacatatgtaaccttgacttataaattacttagaagccaaggcgtaatattagcatttagagcaaagtctggctatgttaagaatgctaacgttatgaagaatcttttctttgttcagtaacaactatagtaagctcacttggatgtttttcatacccttgaaatgtcattcctgtgaactatccctaaacaaaaggcagatgttcatatacaaattgataatacagatatattcagcagtgtctttctgagttaatgtgtctgttggccttctggtaatcccacagtcagctgcctgttcaagatatttacatattttttaaaaaaatacaaattccctggaatcatatcaaagagagaaccatatattttgttcacttaggaagttcttttggcagtccatgatggctgctacatccaatatattttttaattaattgttacttttagagaatgcaagtccatagttaacttattaaactttcataattgatatttctttgatgcttgtaatattttgtttctagcctcaaaaaagtgtgataacttttttgaatacttgcagatgtttacataaaatatcacatttatttatttgcttatttttgagacagagtcccactctgttgcccaggctgaagtgcagccgcacgatcttgtctcactgcgacctctgcctcccaggttcaagcgattctcctgcctcagcctctggagtatttgggattacaggcacataccaccacaccctgctaatttttgtatttttagtagagatggggtttaatcatgttggctaggctggtctcgatctcctgacctcaagtaatccaactgcctcggcctcccaaagtgctgggattacaggcatgagccaccgcacccagccaaaatatcacacttacaaaattgtccctcacacttttctttacaactgttcgtctcggtgttacatccagaatcccagtagaaatgaacggtgaaaaacagagtgcaattccagccttggcctctgagtcttaagatcttgtaggcccttaaaacaagaattgaggccaggcacagtggctcatgcctgtaatcctagcactttgggaggccgaggtgggcagatcatgaggtcaggagatcgaggccaacctggctaatacggtgaagccccgtctctactaaaaaacacaaaaaattagccaggcatggtggcgggcgcctgtagtcccaactactcgggaggctgaggcaggagaatggcgtgaacccaggaggcggaggttgcagtgagccaagattgtgccactgcactccaacctgggcgacagagtgagactccatctaaaaaaaaaaaaaaaaagcaagaattgagttgtttcaattattttgccttaagagacccattatgctgtaatttatgattttattgtggctttgtccttaattatatctaatttaatggttgttattttatagattaaaatgcaatctgagtttttagcattttatagttatctttgtacgttataccatatctgacagtaaagcttcaaatttaaaaaaaaaaggaaatcgtgagttaataaaacaaagtattgagtcagattgtctttttaaattattcatgtattatcttttatccaaattaagtctttttctgaaaatatgttgtatagcagatatttagatgtcggagcctacattatgttgtttttaagtgggggaaaaaacaatgatgcattctctgtccattcaaaaaccctaaccaaacttccccaaatatcacaaaacacctttagacaactatatagcgatctacgaaaacttttgtataacatttacaaaacatttgagacatctcttacctgattttaaaaatacttaatgaattcattatttggtatatttttgttcaataagtaatgagactatacagtattgattataaattagcattttattctatccggtgatgaatagtatactgtatgattctgtattatacatttaaaaaatgaaataatattatttttatctaaataaggcttgggttagtgggatccctaaatgcttaatagaaacaacctctgggaccagagattcttctgtgttcatcctggtaaatatctttcaggtttattaaaatcacaaaggctcccccttgctcagcatctatttttagcaagacaaaagaaggactttttagggtttgtgtttattagtttaggatctgaatatgtttgctgaacttttgacatacactgatttcctgcttatgttaacaccgtcttgcataggttatgttcatttatacatatgagaagagcaaaagagggagttagaaatgtaatattgtggaataatagttaaaaaaattagctgatcaatagtatttggtttatctaagcttgtcataagtgcgttgctctaaataaaagagtatactttaatcaactgttcttattcaataaaataatctattttgccttagcattgattttttctaattatctgaagccttgtctaatgaacaatggtttggactgtttggagtttcattttaagttcaacccttactataaattcattgctatcagatttctgcaatcctgttttttctgcttaatatttctttgagagcccttatatctctctatttatttcccattttccccacaaataatagaaaatttttgactttcttaattattcacattgtatctaggagtcaagcaagtggacagaaaatgcctgttcaatctagtgataggaagaggaccctaaggtagggccagtttggccttttcgaagatcagaaagatggccaagaataggtggagcagtgtttgacagtgggaagagtgaccaaattaggatcagggatggctggagccagaacatgtagggccttctagtccctgttcgggattttagattttgttgcaagtataagatatctgaggggaccctaaacagagtagtaattatcagatttatgttttaaatctcactctggcttctaagtggtgggcagcaggaaggagacaagaatgatgccgattagaaggctgggacagaattccagatgaggaatcagtggtggcttagattagggtggtggcaaatgaaatgaagaaaagtcaaatatgtcttggaagtagaaccgacaaaagttgctaatgtgttggatctggatgggtagaagtgaaaaggagaaatcaaggatgacttctagatttcgagattgttttgcaagttgatggtgccttctacaatagggaaaatgttggggaggaaacattgggggcagatggaattaaaagttctgttttggctatctgaaacttgaggtgcttatttgacttccaaatatatctgcaatatatatgcatcagtttgatgagtttagagcttggcagaggtagatcaaggatggatacatgatatgaatgtggaagttatcattatatagatagtatttaaagccatgggactaaatgaaattactctgaatatttttgtcaccttctctgacctgtaccttctccctcccttaccatgtaaaattattcccacattatattgcaggtacatattttaattatagtacctataaataatttggtgttcttttctttttagtaaaattctctgatttctttatcctgtttatagctaactggtttaagagtattcagttactagcttctatatttaagtgaacgtctaaaaattatgcatttattttctgttttttttttttgtctttgctccaggcaaagtcattaataaagatttgcggcattacctaagtcttcagtttcaaaaaggatcaattgaccacaaactgcagcaagtgatcagagataatctctacttgagaaccattccatgtaagtatgtgatggaataaaagaactgaagcagaaatgtcctttcttaactaattaaacatctacagatagtttgatggagtatttcacatgaaattgtgaagactaagttgggaacaagaatgaaacaaaaattggataagaagaaaaattttcaaagaacttgagaggttttgtttttaaaagtagaaaaatggaaaaactgggccgggtgcagtggctcacacctataatcccagcactttgggaggccgaggtgggtggacttgaggtcaggagttcaagaccagcctggccaacattgtgaaacctcatctctactaaaaataaaaaaattagccgagtgtggtggcgggcgcctataatcccagctacttgggagactgaggcaggagaatcgcttgaacccaggaagaggaggttgcagtgagccgagatcatgccactgcactccagcctgggtgacagagcgatactctgtctaaaaaaaaaaaaaaggccgggcgcggtggctcacacctgtaatcccagcactttgggaggccgaggcggacggatcactaggtcaggagatcgagaccatcttagctaacacggtgaaaccccgtctctactaaaaatacaaaaaaaaaaaaattagccgggtgcgtcgcaggcgcctgtaatcccagctactcaggaggctgaggcaggagaatagcgtgaacccgggaggcggagcttgcagtgagccgagatagcgccactgcagtccggcctgggtgaaagagcgagattccgtctcaaaaaaaaaaagtagaaagtagaaaaactggaagattctatattgtgagttttaaaaagtgatgactagaatttaagattatataatcccagcactttgggaggctgaggtgggcagatcacctgaggtcaggagtttgagactagcctggccaacatggtgaaaccccatctctactagaaatacaaaaattagccgagcatggtggcaggcgcctgtaatctcagctacttgggaggctgaggcaggagaatcgcttgaacctaggaggcggagattgcagtgagccgagatcatgccgttgcactccagcctgggcaacaagagcaagaccctcaactcaaaaaaaaaaaagaaaaaaacgaaaaaaaatatatatatatttttacatgttgttaactagattttattcctgtaaatcaatttgtaaagccttatgcagtaagaagactttttagctcccagtgccttgcataccaagaacaagtattttattagaactttattttaaaataattttaaaatctttcccttccccaacaagaaaaaaaaaaaagaagaagaagaaaaaggaaagggactctctcttacttggaataatttcttttttccctccctccgtggcttcttcccttcctcccttgactatgtagtggcaaagagctaagtaaaattgagttcaaaatctttactctagcatcttactggctactttacttgggcaagttacttaatgttcctgatcctcagaaactctctatatagaattagaataacaagacttacctcatatagctgttactaggatttaaaatgagagcatatatgtaaactgcttggcctagagaggcactcaagcagtgtttgtccccttcccccattctaactggatctcctccctctcatttcacctcgattcaatcagtttttaaagtgcacatttctcagcactataggaaagggaaaaaaatttaaaaataaagtggacatctgattcttgtccaaaatctatagtttatccttcaaagatttctactgacaaagttcagactccttagcatcgcataaaatattttttgtttttttaatctgcctccttatctatgatttcctcctacaaatctaccttgtagctgcagattgtaacttctgcctttatttcaatttgtatttgcctgatgtgtctttgtccatcttgttattcttaaagtctctgaatctctgttttacaaatagttctagactttactcagtagccagtgtgaaacttcttaaatttttattgatgtgatcaatatctttagcctcagttctgtcatggtttttatatttaccatatataagccttttgtatgaaaagcttttcactgtgtagtcattttatttgatctctttttaggaaggtttgtagggatcttttttttaatggttaccttgatacctttatataataatctttgttcctccctccctatttttttgcttctgtctctactatgagtaatattaaaattacttagtcatctcttctttttccttccttctctcccatcatctgacttgaagtaatatctttttattcctacgaaatataaggtaatcagtaaatgtatcccacactttgctgtgcttttctcattcttaccctactttttttgatagttgggctgttgttctacattggctaagcaaatagccattacattactgtactttcctcctttataattatcatttatcttttattctgtgggtaaatacatatttaatataaccaccaatccttatgttgttatttttcactaattgtagttgtctaaagctttttctttactcgttttcccagcaaaggctcacaggatcatcttaggagtttgtttgtggcctttatactttgatgtttgtttggatggatataaaatttttgactcattttctttccttgactatcttaaatatattagtcaactatctaactgtttttggcataaagcattgctcttaaagagtttggtagcaatctaattttcattcctttgtaagtaacttgatattttgcctgcatgggatgtctcatttttagtttcatagctctagagcttcctcttcccttgttaaaacaagataataaaaatatgtacttgtactttctaagataggtcttttttttatactgccctctgccactttcacttaagtttttcttttaattttattgttccagttttgcagtttcctcagtgtgaggtttttatcctagaagggagctaaaatttattttgtttcatttcacagggtccaagcagctgtagcccttttagatctcaacaggccctcttaacttacacaaaaattgaagtgtccaaagctccctctaggaacctagacgcaatgacacatcagtagcaggtagcatactgaagggtcacatgtgatctctaaatatcatactttcctaaaaagtttgaggtctccttggagatagttctgattctaggtctggtacaaggaaagtacaagatgagctttggagcatataagtgtatcagaaagtatatagtgcttaaaacattatagagacatatcagaaggacatagaagccacctagaaggggtgcttgatacttactccaaaaatctgaaacaatttgagcaacaacgttgaaaaaagagggcacttctattattgtcagatattgagctgtaggtggaacaggactatgatccttgagagaagaagaaaggagaccacacacagaggaatcctataatttcctcaactttctacttagaggcactttctggaccacagcacaaggagggagagtccaggcagagtacaatggactctgagttgaagggacagaaatctgagttcaagaagcctgaggtatctggaatttgcaggacagaatgtcacagaggagagggctatgaagaaaaagagctcaagcaatctgtaaaggcacccccttgactctgtggctgaatactaagctgagaatatgtaggaccagactcttcaaggttaaaccaaaaaatctctcggagttttaagtttaacaattcccagagcttacccaggggccaggagacatttgagttctaatcagcttggtggaagaatcccataagggtcctcccttactagcagggctaaaatagtcagataaagctcctctaggcctgctttaacaaagcttaattaagcaagaccccaaaggatcaagtgaatatgcatgcaacttaactgctagcaaaaaaggaagaaagaaggaaagaagtaaatcaacactctttaaagaaagatagtgtctgggctcagtggctcacgcctgtaatcccagcactttgggaggctgaggcaggcggatcatgaggttaagagattgagactatcctggcctacatggtgaaaccccatctctactaaaaatacaaaaattagctgggcgtggtggcgggtgcctgtagtcccagctacttgggaggctgaggcaggagaattgcttgaacctgggaagtggaggttgcagtgagccgagatcgtgccactgcactccagcctggtgacagagcgagactacgtctcaaacaaacaaacaaaaaaatagaaagacaacaaaatggaaacattgtgtaacaaaatattcagagtgtccagcatctaataaaaaattactagacctgcaaaaagcaggaaaatgtgacccataatcaaaagaaaagtcagctgatagaaaaaagaaacagaaatgacacatgatggcattactataccaggagttttagttattagaaatatgctcaaggatttaaagaacagtatcaacataatgaagagaaaaattatatataaatattcatatgtgtgtgtgtgtgtgtgtatgaatgaagtggaaccttaaaaattcactgaatggactcaacaggagattcaaaactggagaagaaaagatcagtgaacctgaacacgtagcaatataaactaatgaaactgaagcatagagaagaaaatgactgaaaaagtgaacttttttttttttgagcaaccagatgacaatggggaggggagagatttctacttctgcaatgaagtaccagtaccataactagtactagatttacccttttgtaataaagaactggaaattggacgaggaatatgtaacagctgttttcagacattgaaatacaggcagaacaggactatgatgcatttatatttacccatgacaaactatcaagccaaagtggaggaaggagaaaaaaaagaaatagtgactgaaatgtttccaaatttgatgaaaataataagtgcacagatctaagaagctcaatagatcccaagcagaagaaatgtgaagaaaaccatatcaaaggacatcataattagattataaaaaaccattgataaaaagaaaatgatgctgggcatgctggcatgtgcctgtaatctcaacacagcaggaagctgaggtgggaggatcacttgagcccagaagttcaaatccagcctaggcaacatggtgagaccccatctctaaataaagtgaaataaaataaaaatttttgaaaaagaaaatgcaaaatacagaaaaaaaagataaattacatgcaagggaacaaagaatgactgcagtatccacagaaacagtataagccagagtccatcaaataacatctttaacatgctgcaaggaaaaaaaaaaacgccaacctggatttctatgtacaacaaaaatatccttcaaaaatgaaagagaaataaagaattttcagacaaaaagtgaaagaagttttcagcagcagatatacactgtaagaaatattaaagattggacaaaatgcacaaacaacaaacgaaatgttaaaggaaattcttcaggtggaagagaaatgatatcagagcaatagaactgaaaggaaaatagacaactttataattacagttcaagatttcaacatccccttttagtaattaattttaaaattaagtaaaacatcagtaaggtaatagaaaacatgaacagtattttcaaccagcttggccgagttactatttattagaagatgccacccaacagcagcagaatacacatgctttcctagtgcagatgatacatttacaaatatagaccatattctgcaccacaaaacaagaactgatagatttaagaggatttagacttaaatcatatgaaacatgttatctagccatcatgaaattaaattagaaattattaacgatggtgggaggattgcttgaggccaggagtttgagaccagcctgggcaacataccaggaccccgtctctacaaaaaaaaatttttttaatgaggcaggcaaagtggcacatacctgtagtcctagctactcgagaggctgaggcaggaggatcccttgagcccaggagtttgaggctatagtgagctataatcatgtcaggaatgagaccctgtctcttaaaaaaaatagagaaagaaagaaattactaacagaaagatattcagaaattaataattaatagcacacttctaaataaactgtgagttgaataaatcacaaaggagattacaaaatattacacatatcaaccaacaaattgaaatgtatcaaacacaatatatgaaaatttgtaggttgtagctagagtagtatttaaatggaaacttacagtattaaatacttatattagaaaataatgaagatttcaaattagtgatctaaaattctaccttgagaatcttaaaaagaaggaggaaaatacttattttaagtagaaggaagaaaataataaaaagtagaaaccagtgcaatagaaaatagaaaaaaaccaatgaaatacaaagctcattctttgagatcaataaaagtgataaacctctagctagactgcttaggaagaaattaagcacaaattagtgctatccggaggccgggtgcagtggctcatgcctgtaatcccagtgctttgggaggctgaagcaggaggattgcttgagtccaggagtttgagacaagcctgggcaaatagtgagactctgtcactacaaaagaaaacaatatcaggaatgagagaggtgacatcactgaaaatcctatagatgttaagtgtgtaagtgtatgataaagattttttttttttttttttttttgagacagagtctcactctgtcacccaggtcctggaattcaatgatgtgattagagctcaacttccatttcttccatctcctgggctcaagttatcctcttgcctcaacttcctcagttactggaactacagatgtgtgccaccatgcccagctaatttttttttaattcttattagagacgacatcttgctatgttgcctaggctggtctcaaactcttgagctcaagcgatcctctggccttggcctcccaaagtgttggaattacagacgtgaggccccacacccggcctaataaggaatattctgaataactttatgccaataaactcaacaacttagatgaaatggacaaattctttagaagacaaaaactaccagtgctcactcatgaagaaataggtgagctgaaaaatcctctatctattaaagaaattgaattttagtttttaactttcctataaagaaaactttagcagagaggggtaggcaccatctctgctgtttggtcgactcagccattccagcctgcgggctttggagagtccaaaagtttcagacaagggagcgtccccccagcagcacaacatagtggctttgccagatcatgaccagactgctgctttaagcagcctggatcacttccttctcactgggcagggactcccagttgggcccttcagccatgcccactggcacatactatggacagagctctgatctctccctgggatggagtgccccagggaggggagggctgccacctgggttggatggatgactcaactgttccagcctgcaggctttggagagtccaagctgatgggcagaagtggttctccaccaggacacagctgttttgttgaggtgtggccagactgtttctttaagcgggactctgatccgctcctcatctcagctgatcctcccagctggctcttcacagccagggcctccagccaccacccatgttctatggaactgacagagctccaatttctccctgggacagagtgcctgaggggtgggcaagctgccaccttggccgtttgggctcgtcaacgggtccaacctgtaggccttggagagcccagaccaatagggagctgaagggatccccaacacaacacaacacaactcctttaccaaaaagcagccacactgatgccattcgtcctgactgggtgagacctccttactggagtatccagccacctcctacaggtacgttcgggctggcagtagttcagtacccacctgggacagagcttccagaggaagcagcaagctgccatccttgctgttttgcagacttcactggcaatacctccaggtacaggaagaaccaaggcaactagggtctggagcagacccccagcacgctccagcagccctgcagaagagtggccagactgttaaaagaaaaacaaacaaataaacagaaaacagcaacgaagaaaaaccacaaaaaccccatccaaagatcagcaacctcaaagatcaaaggtacataagcccacaatgatgagaaagaatcaatgcaaaaaaagctgaaaactcaaaaagctagggtaccccctctcctccaaatgaccacaacacttctccagcaaggtctcagaaccaggctaaggctgagatggctgaaatgagagaagtaggctttagaagatggttaataatgaacttcactgagctaaaggagcacattgtaacccaatgcaaagaagctaagaattatcatagaacagtacaggagctgacagccaaagccattttagagaggaacataaccccctgttatagctgaaaacacactacaagaacttctcaatgcaatcacaagtattcatagcagaataaaccaagcggggaaaagaacctaagagctggaagactggctttctgaattaagacaggcagacaagaataaagaaaaaagaatgaaaatgaatgaacaaaacctccgagaaatcagggattatataaagagaccaaatctacgactgactggggtacctgaaaatgatggggagaatggaaccaagttggaaaacatacttcaggatatcatcaaagagaacttccccaacctagcaagacaggccaagccaacattcaaattcaggaaatgcagagaaccccagtaagatactccatgagaaaatcatccccaagacaattcataatcagattctctaaggttgaaatgaaagaaaaaatgttaagcacagccagagagaaaggccaggtcacatacaaagggaagccaccagataaaaacagtggacctctcagcagaaaccctgcaagccagaagagattggggccagtagtcaacattaccaacccagaatttcatatctggccaaaccaagcttcataagcaaaggagaattaatatcctttacagacaagcaaatgctaagggaattcattactgctagacctgccttgcaaaagcaccttaaggaaacactaaatatgaaaaggaaaaagcatcattaccaaccactacaaaaatacactgtggtgcacagaccagtgacgttatgaagcagccaccataaacaagtctgcaaaataaccagctagcatcatgatgacaggatcaaatccacacataaccatgctatccttaaatataaatgggctaaatgccccaattaaaagacacagaatagcaagctgtataaagagtcaagatccatcaatatactgtcttcaagagacccatctcacatgcaaagacacacataggctcaaaataaagggatggaggaaaatttatcaagccaatggaaaaaagcaattctagtttcagacaaaatagacttcaaccaacagactttaaaatagactttaaactaacaaagatcagaaaagtcaaagaagggcattacataatggtaaagggttcaattcaacaataagagccaactaccctaaatatatatgctcccgatacaggagcacccagattcataaagttccttttttttgtttttttttgagagggagtctcactctgtcgcccaggctgaagtgcagtggtgcgatcttggctcactgcagcctccgcctcctggattcaagcaattctcctgcttcagcctcctgaatagctgggactataggtgcccaccaccacacttggctaattttttgtatttttttggtagagacagagtttcaccatgttggctgggctggtctcgaattcctgacctcaagtggtctactcatcttggcctgccaaagtcctgtgattacaggcatgagccactgtgcctggccataaagcaagttcttagggaccttcaaagagacttagactcccacacaataatcgtaggagactttaacacccactgacaatagtaggcagatcattgagacggaaaattaacaaagatattcaggacctgaattcagctctggatcaagaggacccgatagttatctacagaactctccaccccaaaacaacagaatatacattcttctcatcactgcatggcacttagtctaaaactgatcacataatcagaagtaaaacactcctcagcaaatgcaaaagaactgaaatcataacaatctctcagaccacagtgcaatcaaattagaaatcaagattaagaaattcactcaaaaattagttgagtatggtggcacactcctgtagtcctagctactcggggctgaggcaggagaatcgcttgaacctgggaggcagaggttgcagtgagctgagattgtgccactgcactcctgcctgagtcacagagcgagactccatcttaaaaaacaaacaaaaaaacaaaaacaaacaaaaaaaaccaaaaaaacaataaaacaaaaaaagaaaaaaggaaagaaagaaagaagttcacttaaaaccatacaactacatggaaattgaacaacctgctcttgcatgattcttgggtaaataatgaaattaagacagaaatcaagaagttctttgaaaccagtgagaacaaaaagacaacacatcagaatctctgagatacagctaaagcagtgttaagagggaaatttatagtactaaatgtccacatcaaaaggctagaaagatctcaagttaacaacctaacatcacaactaaaagaactagagaaccaagagcaaacaaaccccaaagctagaagaagacaagaaataaccaagatcagagctggactgaagcagacagagacatgaaaaacccttcaaaaaatcaacaaatctaggagctgggtttttgaaaaaaataataaaatagacttcaagctagattaataaacaagaaaagagagaagattcaaataaacacaatcagaaatgataagggggaataccaccactgaccccacagaaatacaaacaaccatcagaaaatactataaacacctctttgcaaataaactagaaaatctagaagaaaatggataaattcctggacatatacaccctgtcaaggctgaaccaggaagaaattgattccctgaagagaccaatagccagttctgaaattgaggcagtaataaatagcctaccaaccaaaaaaagcccaggaccagatggatttatagctgaattctaccagaggtacaaagaggagctggcaccatttcttctgaagctattccaaacaattgaaaaggagggactcctccctaaccattttatgaggccagcatcatcctgataccaaaacctggcagagatacaacaaaaaaagaaaacttcaggccagtatccctaatgaacatcaatgcaaaaaccctcagtaaaatactggcaaaccgaatccaacagcacatcaaaaaacttatccaccacaatcaagtcagctttatcccgaggatgcaaggctggttcaacatacacaaatcaataaacgtaattcaccacataaatagaactaaagacaaaaaccacgattatctcaatagatgcagaaaaggcctttgataaaatttaacaacccttcaggttaaaaattctcaataaactagatattgaagaaacatatctcaaaataataagagccatttatgacagacccacagccaatatcataccgaatgggcaaaagctggaaccattccccttgaaaaccagcacaagacaaggatgccctctttcaccactcctattcaatatagttttggaagttctgaccagggcgatcaagaaaaagaaagaaagaaagcatattcatataggaagaggaagtcaaactatccctgtttgccgatgacatgatctcctatatctagaaaattccaccgtttctgcccaaaagcttcttaaactgataggcaacttcagcaaaatctcagggtacaaaatcaatgtgcaaaaattgctagcattcctatatatcaacaacaggcaagctgagagccaaaatccagaatgaactcccattcacaattgccataaaaaagaataaaatacctagaaatacagctaacaagggaagtgaatgacctcttcaaggagaactacaaacgactgctcaaagaaatcagagatgatgatggctgagcatggtggctcacgcctgtaatcccagcactttgggaggccaaggcgggcagatcacgaggtcaggagatcgagaccatcctggctaacacggtgaaaccccgtctctaccaaaacaaaaaaattagccaggcatggtggcgggcgccaatagtcccagctactgaggaggctgaggcaggagaatggcatgaacctgggaggtggagcttgcaatgagctgagatcgtgccactgcactctagcctgggagaccgcgagactccatctcaaaaaaaaagaaatcagagatgatgacacaaacaaatggaaaaacattccatacttatgaataggaagaatcagtatcatcaaaatggccatactgcccaaagtaatttatagattcagtgctattcccattaaactaacattgacattcttcacagaattagaaaaaaactattttaaaattcatttggaacagaaaatcagatgttctcacttataattgagagctgaatgatgagaacacatggacacatggtggggaacaacacacactggggcctgttggagggttgcgggtgggaggaaggacagcatcagtaagaatagctaatgaatgctgggcttaatatgtaggtgataggatgatctgtgcagctaataccatggcacacgtttatgtaacaaacctgcacaacctgtgcatgtacccctgaacttaaaagttggaaaacagaaaactttaggcccaggtgatactggtaaattgttctgaatatttaagaaagaaataataccaattctacacaaactcttctagaaaatagtggagggaacatttcccaactcattctgtgttgtgaacatgattctgattctaaaatcagataaaaatattaaaagaaaatgttaggctaaaatttttcttgaatgtagactcaaaaattcttaacagtattttagcaagtcaatatatatagcaatatgtaaaaggataatacattatgatcaagtggagtttgtttcaggaatgccaagttggtataacatttgaaaattaatatagtaatattagaaaacaaaaaccaattaattttttcaatagatgcagaaaagttatttggcaaaattcaactcccatttatgacagaatctgtcagaaaactagtctgccatttattacccattgcctcttggctataaatctacttttttgcctgcttgtgatactgtaacatttgtctcctgtccattggcacagtgttaagctttcaatagcgagcacagaaaggatactggagaaagaagagagttcttttcctggttccagtgtgtctttttctttttgctcctgctatccaaaaagacacccagcaagtttcagcagtaccctagcagtcagcttccctgtgacaagttcagtggcacacctgcaggagacttccttacagcaagttcagcaacaccctgataggtgatttcatgagtaccagcagtgcaccagctgacttatagtttcctggtgagttctgtgacatcccatttggtcccccagttttcagcaacatcctctgagaaccagttttcctatgggtttctcgcaagtccagccaatgtcttagctggttttctattcacaaacctcactcaccaccataggtagcttgctggcgaatttcactgataccccatgcagtttcctgcctgttaaatccctgacccactaactgtgaactagctctgtcctcaggcaacccaggaaaattccccaccatccagtgggctgttaccataccctcttcaatgaggtctaaatcccagaccttgggagagtccctcccttccaagtttgttccttatttaaatattctccctcagctttagggtgatattctttagagtcctcgtttattcctacttagttaattccctgtaaacagttaacaattctgtatattaaactgtctctgttcagattgccatgtggtttctctctcttctctggatcttgatacagaattagtactagtagcgctcccaggagacagaacctctaagaagggatttcagaattggttttggttgtcttggctgatcttacgtggagtgccaagtttcttccaatgagaggtgggatgctgataattcatgagaagccatggcatcacaatttaattacagtatcacttatggttgattgtgaagaaatgacaaatgaacccagtaccttgagagcccaaatgactgctgcacttgactgttatggcagtagttatggctacgaacactgtagtttaggatagattctcctgtgtggcaagtgcttacagagagaaactggcaagataaaatcaaatggtttactattgttgttattattatgaactaataaaataagattttgttactatttttcaatgatctctacttgatacagatgtctgataatagaaaaacttaaggagacattggttgggcatgttggctcacacctgtagtcccagcactttgggaggctgaggcggaaggaactcttgaagccaggagttcaagatcagcctgggcaacatagcaagactgcacctctaaaacaaatgaatgaatggaagcattaacacaaaataaataccaaataaaaatcatttaaaatttgaaagataatcacatacgtatttagtatttgaatttttcatacctaaaattgtagttatttatttatttatttatttttgatttatttatttatttttgagacagagtcttgctctgttgcccaggctagagtacagtggcacgatctcagctcactgcaacctccacctcccaggttcaagtgattctcctgcctcagcctcctgagtagctgggattacaggtgtgcgccaccatgccctgcaaatttttgtatttttagtagagatggggtttcaccatgttggccaggctggtctcaaactcctgacctcaggtgatccgcccgcctcagcctcccaaagtgctgggattgcaggtgtgagccaccgagcccaaccctgaaatgaaattttaaagcacaaagtatcaattgttttatctgatggtcttgatctttgtttggtgataaatatgccagaaaaaaatgtatttcattttgcactgacattcatcaaattattaagaatgtatccaaaaacatcctcatatcgggcattacaaagtatgttgtttcatgtaatctcattttcttttttaattctgaaagcatttcgtctgcttctcctgattttgattttgccgttgaaatctattaaatatattgcttttatttcagattttagatccgtttcttatttcatgttggaatgttccacaacagcattcactttctctctttgcattttttctgttaaatatttacaaagcactgaagcttgtaacaaataatcagtgaaaaatgccagaaaatattattggatagtattcaaataacctaacatttagatttctgagcatggttaacagcattacacagagttgtgtgttgaaactgccaatttaaggacttacttagcctccaaacttgttatttcttggaactcaacttataggatttatatgaagtataatatacatatcatcttattagtattgttttatgtaagaaagacccaccactagcagatatggccatgagcacacacttgtgggaacagctgcaagtaagactgacttgagtgtattgtgactactactctcccacatgcttctgtcctggttcctggaaatatcaaccttaacctttgattctgcctttcagtgtttcctgctcttgctttcatttgatatcagctgatttcttcaagccagatgtctctatgtcaaattattaaactttagtttgtgcaggagaattagaactttttttgtcatttttcatatcaactgatttgttgtaaatttagagaaagcaaattaccctagaaactccagaaggaattcctacttagtaacataaatcaaccgcagctctcatatattgcaggtgggaatgcaaagacatctactttggaaaataatgtgatgttttcttatcaaattaaacatacacttaaccataatacctagtaatttcactcctaggtattaactcaacatacatttaaatatatgtctacccaaagtcatgtaagttaatagcagctttatttattatagcccaaatgtggaaacaacccaaatttccatcattggtgaatggataattaattttggtatattcatacagtagaataccaactgaataaaacaagacaaaagatcaatgaggaaacagaggacttgaacaatacaagaccaaatggacctaaccgacatacagaacatttcatccaataacagcagaatatacactcttatcaagcatgcatggaagattctctatgataaaccacattagaccacaaaacaagtcttaataaatttaagatttaaattatgcaaagtatcatctctgaccataatggaatgaaactaaaattaattagcagaaagaaaacaggaaaatttgcaaatacatggaaagtaaacagtgtgttcttaaacaaccagtggatcatgagagaatttaggaaatacctggagataaattttttaaaaagatacaacatactaaaacttatggaatatagtaaaagcagtactaagagggaagtttatagcagtaaacagattaaaagagaagaaaaatctcaagtcaccaacctaatcttataccttaaggaattagacaaataagaatgaactaaatccaaagtcagcacaaagaaggaaataataaagactagagcagagataaactgaatagaaaacattaaaaaaaaagaaaaaaatcaaccaaaccaggagttgtttttttttaaaaagaaaatcactaaaattgataaacccttacttagattaagaaaaaaagacttaaatttctaaaattaaaaatgaaaaaggagatattataactgatgtcacagaaatgaaaagaattataaagactgctgtagtgaaaagttagatgcccacaaattggatgatctagaagaaatggataaagttttagagatataaacctaccaagactgaatcataaagaaataaaaaatctgaaaagacctataatgagtgtggagattaaagcagtaatcaaaaacctcccaacaaagaaaagcccaggaccaggtgggtcccctggagaattctaccaaacagttaataccagtccttctcaaattcttccagtgaacggaagagaaagggacactctcaaactcatttaaactcattaccctgataacaaaaccagacaaagacacaataaaggagaactacaggccaatatccctgatggatatttgacacaaaaattctaaagaaaatactagcaaaccaaattatattgcacattaaaaaatcatacatcttgaccagctaaaatttatgcctggaatgcaaggatggttcaacatataagactcagtcaatatattatgccacattaacatctcaatacagaaaagcaaaattcagtaccctatcaggatttttaaaaatactcaacaaattaggagtagaaggaaactacctcaacataataaaagctaacattatgcttaacaggaaaagacagaaggcttttcctgtgagatcctgcaataaagcaaggatgcctggtcttgccattactattcaacatagtactggaaattctagccagagtaataagacagcaaaaagaaataaaaggcattcaacttagaaaagacttaaaagatctctctttgcagataacatcttaaatgtaaaaagaatttgaacaacatgggtgaatctcaaaagcattatgctaagtaaaagaagccagacaactactggaatcaaattaatgtatgattccatttgtattaaattatattaaaggcaaaactatactgacagtaggtcagtaactgcccagagtggaggactacaaagaggcccaaggaaactttgggggataatggtttccaaagttcacataattgtactattagaattagtgcattctattgtaggtaaattatttctttcataccatcaatatttagaaaatgaaagtttatgaaaatattacttaccatagcatataagttttttaaaaatacctagaaattaacctctaatgaaacgtaagtcctctatagtgtgaaattgagggatgctaaagaagatctaaatatgctgacagaaatttcttattcatgaattaaaggcagtatggcaaagataccagttctgctcaaattgacttgtagattcaatgtaattccataaaaatttcagcctttttagcctgtttatctgattctagaatgtatatggacaggctttgaatacaaaaagcaagataggtggacttgctatactatatatcaagatttattaggaaaatagaataattataacactgataatgataccagaatggtcagtagatagaaagcctagtagtaaacacccaagcttatatagacatttccatgaaagaagtgctgtggctgatcagaagggaaattaatgacttttaataaattattttgagtagtcatttggaaaaaaaggaaattagactggtacttctcaccagctcccccatccccaccatctgttttttgtgttaaagtcctaggtgtgaaaggcaaacctgtagtgctttttaaaaagaatatagaatatctccatagctttaggaaaggatttttttcaactagacacaaaaaccattagctgtaaaggaaaagatttatacatttgactacattaaaattaagagcttctgtcatcaaaatacaatttcttaaaaaggtgaaaaaatcagaatgtgacaagatactctctgttcctctacatttatttctgcagtacaaaaaagtttacatgtgattggcacatatgtagaaaatgacatgaatttaactcaggttatactagtttctatgccattttcctcagcaagctaatgttttttatcatcaaatagctacaagtaaataaaataaaagaacacaactgaatattgcagctgaggaagaatatggcagtgtatatgatacctatacacttcaatttatcctcttttctgtttgaccatgtgttctgttttaaaaatctttattgcactatttgccctatcttcattatttagtagcctaacactttcttatacccgtttctgtcaagccaccttttcttttcattcctttcattttcttaaaagaccagtattttatttactctgttatttttaattgggaatttaacatgtcttttaaactgtattaatattttaaattaggaccattatttattttgttagtgttctagttacaaagttgcaaaggttttgagaagtcaaccatgactctattttcttcataatctctcttattatgggtgcatgatttttcagaaagtactatttcaagaaaacatatttcacagaaatcccccatttgcaatacatatgtctgacaatggatcacagtacttcatcaatactaagacagttatttcacattttaacatctctacagttgggaagcatcttagaatagatgaaatctttcaattataattgccagggttttttctttcttagagataaaataatgatgcagtttagaaggggttggttacttagatttgatgatttactataatattcagaatataaagaattataaatcaattttattttattttttattatactttaagttctggaatacatgtgcagaatgtgcaggtttgttgcataggtatgcatgtgccatggtggtttgctgcacccatcaacctatcatctagattttaagcctcacatgcattaggtatttgtcctagtgctctttcaccccttgccccccacaccccgacagaccccagtgtgtgatgttgccctccctgtgtccatgtgttctcattgttcaactcccacttatgagtgagaacatgtggtgtttggttttctgttcctgtgttagtttgctgagaatgatggtttctagcttcacccatgtccttgcaaaggacatgaactcatccctttttatggctggatagtattccatggtgtccctgtgccacattttctttatccattctatcattgatgggcacttgggttggttccaagtctttgctattgtgaatagtgctgcaataaacatacatgtgcatgtgtctttatagtagaaggatttataatcttttgagtatatacccagtaatggaattgctgggtcaaatggtatttctagttctagatccttgaggaatcgccacagtgtcttccacaatggttgaactaatttacactcccactaacagtgtaaaaacgttcctatttctccacatcctctccagcatctgtcatttcctgactttttaataatcgccattctaactgatgtgagatggtgtcttgttgtggttttgatttgcatctctgtaatgaccagtgatgatgagctttttttcatatgtttgttggccacataaatgtcttcttttgagaagtgtctgttcatatccttcgcccaatttttgatggggtagtttgtttttttcatgtaaatttgtttaagttccttgtagattctggatatcatacctttgtcagatggatagaatgcaaaaattttctcccattctataggttgcctgttcactctgatgatagtttcttttgctgtgcagaagctctttagtttaattagataccatttgtcaattttggcttttgttgctattgtttttggtgttttagtcatgaagtctttgcccatgcctacgtcctgaatggtattgcctaggttttcttctagggtttttatggttttaggtcttacgtttaagtctttaatccatcttgaattaatttttgtgtaaggtgtaaggaaggagtccagtttcagttttctgcatatggctagccagttttcacaacaccatttattaaatagggaatcctttccccatttcttgtttttgtcaggtttgttgaagattagatggttatagatatgtggtgtcatgtctgaggcctctgttccattccattgttctatgtatcggttttggtaccaataccatattgttttggttactttacccttgtagtatagtttgaagacaggtggtgtgacgcctccagctttgttccttttgcttaggattgtcttggctatatgaggtctttttgtttccatatgaaatttaaagtagttttttctagttatgtgaagaaagttaatggtagcttgatggggatagcattgaatctataaattactttgggcagtgtggccattttcacaatatcggtttttcctattcatgagcatggaatgtttttccatttgtttgtgtcctctcgtatttccttgagcagtggtttgtagttctccttgaagaggtccttcatgtcccttgtaagttggattcctaggtattttattctctttgtagcaattgtgcatgggagttcactcatgatttggctctctgtttgcctatcattggtgtataggaatgcttgtgatttttgcacattgatttttgtatcctgagactttcctgaagttgcttatcagcttaaggagtttttgggctgagaagatggggttttctaaatatacaaccatgtcatctgcaaacagagaaaaattgacttcctctcttcctatttgaataccctttatttctttctcttgcctaattgccctggccagaacttccaatactacgttgaataggagtggtgagagaggggatccttttcttgtgccagttttcaaagagaatgcttccagcttttgtccattcagtatgatattggctgtgggtttgtcataaatagctcttattattttgagatatgttccatcaatgcccagtttattgagagtttttagcatgaaggtgtattgaatattattgaaggccttttctgcatctattgagataatcatgtggtttttgtcatttgttctgtttatgtgatggattatgtttattgatttgcatatgttgaaccagcgttgcatcccaggcatgaagccaactggatcgtggtggatgagcttttctatgtgctgctggattcagtttgccagtattttattgaggtttttcgcatcgatgttcattagggatattgacctgaaactttctttttttgttgtgttctgccaggttttggtatcaggatgatgctggactcataaaatgagttagggaggagtccctctttttctattgtttggaagagtttcaaaaggaatggtaccagctcctctttgtacctctggtagaatttggctgtgaatccctctgatcctgtgctttttttggttggtaggctattaattactgcctcaatttcagaacttgttactggtctattcaggagttcgacttcttcctggtttagtcttgggaggatgtatgtgtccaggaatttatccatttcttctagattttctagtttatttgtatagaggcatttatggtattctctgaaggtagtttgtatttctgtgggatcagtggtgatatcccctttatcattttttattgcatttatttgattcttctctcttttcttcttttttattctggctagttgcctgttttgttaatcttttcaaaaaaccagctcctggattcattgattttttggagggtgtttcatgtctctatcatcttcagttctgctttgatcttggttatttcttctgttctgctagctttttttttttgagacagagtctcactctgtcacccaggctggagtgcagtggcacaatctcggctcactgcaagctccgcctcctgggttcacaccattctcctgcctcagcctcccaagtagctgggactacaggtgcccgccactacaccctgctaattttttgtatttttagtagagacagggtttcaccgttttagccaggatggtctcgatctcctgacctcgtgatctgcctgcctcagcctcccaaagtgctgggattacaggcgtgagccattgcacccagccctgttcggctagcttttgaatttgtttgctcttgcttctctagttcttttaattgtgacattaggttgtctattttagatctttccagttttccgatgtgggcattcagtgctataagcttccgtctaaacactgctttagctgtgtcccagagattctggtacattttgtctttgttctcattggtttcaaagaacatctttatttcttccttaatttcgttatttacccagtagtcattcaggagcaggtttttcagtttctaagtagttgtgcagttttgggtgagtttcttaatcctgagttccaatttgattgcactgtggtccgagagagcgtttgttatgatttccgttcttttgcatttgctgaggagtgttttatttccaattatgtggttgattttagaataagtgtgatgtgctgagaagaatgtatattctgttgatttggggtgaatagttcagtagatgtctattaggtctgcttggtccagagctgagttcaaatcctaaatatccttgttaattttctgtcttgttgatttgcctaatattgacagtggggtgttatagtctcccactattattgtgtgggaatctaagtctctttgtaggtctctaagaacttgctttatgaatctgggtgctcctgtattgggtgcatacatatttgggatagttagctcttgttgcatggatccctttaccattatgtaatgcccttctttgtctcttttgatctttgttggtttaaagtctgttttatcagagactaagattgcaacccctgcctttttttttctttccatttgcttggtaaatattcctccatccatttattttgagcctgtgtgtgtctctttgcacatgagatgggtctcctgaatacagcacaccaaaaggtcttgactcctttatccaatttgccagtctgtgtcttttaattggggtattcagcccatttacatttaaggttaatattgttatgtattaattatatcctgtcatcatgatgctagctggttattttgcacattagtcgatgcagtttcttcatagggttgttggtctttatattttggtatgtctttgcagtggctggtaccaatttttcctttccatatttaatgcttccttcaggagtaaggcaggcctgttggtgacaaaatccctcagcatttgcttgtctgtaaaggattttatttctccctcacttctgaagcttagtttggatagatttgaaattctgggttgaaaatccttttctttaagaatgttgaatattggtcgcctactctcttctggcttgaagggtttctgcagagatctgctgtgagtctgatgggcttcctttgtaggtagtctgacctttctctctggctgcccttaacattttttccttcatttcaaccttagagaatctgacgatcatgtgtcttgtgattgcttttcccaaggagtatcttagtagtgttctctatatttcctgaatttgaaagttggcctctcttgctaggttgcggaggttctcctggataatatcctgaagtgtgttttccaacttggtcccattctccctgtcactttcaggtataccagtcaatcataggtttggccttttcacatagtctcatatttcttggaagctttgtttgttccttttcattcttttttctctaattttgtctttatgctttatttcattaagttgatcttcagtctctgatatccgttcttccacttgattgatttgcttattgatacttgtatatacttcatgaagttctcgtgctgtgtttttcagctccatcaggtcatttatgtttttctctaaactggttattctagttagcagttcctgtaaccttttatcaatgctcttagcttccttgcattgggttagaagatggtcctttagctcagaggagtttgttattacccacctcctgaagcctacttctgtcaattcatcaaactcattctctgtccagttttgtgcccttgtcagagaggagttgtgattatttggaggagaagaagcattctggtttttggaattttcagcatttttgtactggtttttcctcatctttgtggatttatctacctttgatctttgatgctgatggcctttggatggggtttttgggtgagcgtccttttggttaatgttcatgttattgctttctgtttgttagtttcccttctaatagtcaggcccctcttctgcaggtctgctggagtttgctagaggtccactccagaccctgtttgcctggtatcaccagcagaggctgcagaacagcaaagattgctgcctgctccttcctctggaaacttcctcccagaggggcacccacctgatgccagccagagctctcctgtatgaggtgtctgttgactcctactgggaggtgtctcccggtcagaaggcatgggggtcagggacccacttgaggaggcagtctgtcccttagcagagcttgagcagtgtgctgggagatctgctgctctcttcagagtcggcaggcaggaacatttaagttactgaagctgcacccacagctgccccttcccccaggtgctctgtcccagggagatgagagttttatctataagcccctgactggggctgctgcctttctttcagagatgccctgcccagtgaggaggaatctagagaggcagtctggccacagccgtttttctgcgctgcagtgagttccacacagtccgaacttcctggcggcttccttaacactgtgaggggaaaaccacctactcaagtctctgccatggtggatgcccctccccccaccaagctcgatcatcccaggtggacttcagactgctgtgctggcactgagaatttcaagccagtggttcttagcttgctgggctctgtgggagtgggacccactgaccaagaccacttggctccctggcttcagccccctttgcagggaagtgaacagttctgtctcactggagtacaaaaaaaaactcctgcagctagctcaatgtctgcccaaacagccgcctcgtttcgtgcttgaaacccagggccctggtggtgtaggcacacgagggaatttcctggtctgcaggttgcaaaagctgtgggaaaagcatagtatttgggccaggtagcacagtccctcatggcttcccttggttaggggagggagttccctggctccttgtgcttcctggatgaggcgctgccccaccctgcttctgctcaccctccgcgagctgcacccactgtctaaccagtcccaacgagattatctgggtacctcagttggaaatggagaaaccacccaccttctgtgttggtgttgctgggagctgcagaccagagcttttcctatttgggcatcttgccagctcccacaaatcaattttaaagacacaaacccaacagagaaatggggaaagacttgaataaccacttcacaacagaggaaatctatatggcttctaaatgtattaaaaagaatgtttaatctcataaagcaattgctttatgaggttgaagtgaagggtaaaatcttgagtagccctcctatttttcggatgtcttgttcattgttgaggttgtggatgatatatccggagcatatgaatagtatggctttaaagaaagtgtgggattaaataaacagtgaagtgactttacacacccaggatattggaaaaatcttataagcctcatgacaagtattggtgtggacagaagagaatgcatgttatgtgattccattcatacgaggttgcaaaagtggcaaaactaagctatgttgcttaaaaatgcattatttagttggtacaatcattaaaaaggaaaggaaatcatcacagatgtcaagatggtagtcacttttgaggatggagggagggagaggtttatcatcagagacacacaagaaggtttttgaggtcctggtaatgttctgctttttgcttgggttgatttgcttgtaactaaacagaaagggtaaatgatcagttatgtcaaatgttattcataggtcagttaagatgagggtaagacttggccattgagttcagcaaagtggagactattgttgaaacatagcacattgtctcagtgaatggttggggaaaagatcttatttgaataggctcaggagacagtgagaggagaattggagactgtgtatggctccaaagaactcttcggagcaatttttatgtataaaggagaaatgtggtgagaagtgggggtgaggggggatgtagaaagctttatataaaatatacagtattaggagaatataaagataaattttatggaatgcgaaaagtaatggggtgaaggaaggaagataactttatgtgtattgggttgtatggttttgtggggggagtgaaaatttataatactttgtaaagagaattaacattaaaactattttctagtcttagaaatatatggtagaattacacataccattcatatctgtccatgaaaagaatcatggacaacatcctgctcaacaccaccttgcagaaagagaaagccaaaagagattaagtagttgcctaaattgtgccgttaataataatcacagaccaaaacagagttcctcctgccctttcgatcagtgctgtttttatagtattatctataatatggcttgcttttaaattgttttttagtcattatgttttatagtggagtttatttggatatctcaattagcctttgctgtataacagactaccctaaaacttagtggcttaaaatagtgatgtttatttctcatgatttcatgagttgggctcagtcgggaccattcatgtggctataatcattgacagctcaactggagctggaggggctaagatggcctcattcatgtgtctggggccttgctgctttttgttggcttgggctctctttatcactcagtagtctagcctggacttccttgcatggtagcaggagcattccaagagggtgaatatggaagtctagatccctaaacttggacaacatcacagcctttacattaaattaatcaaagcatatcatcaatccagtccaaattcaagggatgaggcaacaggccccacctcttaggaggtgcagaatatcgtcatcatattttttccatctgtcatagataattacaaattataattttaatccttgaatttccttttttttttaagagacaggatctcactctgtcgtcaaggctggagtgcagtggtgctgcaatgataacccactgcatcactgcatccttcaactcctggtctcaaattatcttcccacctcagcctcacgagtggctaggactactggtgtgcatcactatacctggctaattttaaaaatttttttatagagacgaggtcttactatgttgcccaggcttgagttaatgtctaatgttaacttttatttaatatggagctaagaagctgttgattcagagaatctaacaatgtagttttggtcaataatgagaaatataaaaatttgaaaataaaaaacgtattaaaaattaaaggaaaaaagctgttttccagattttatatcctctatgatgtaaaacaggtaaagaaatgcttatttttagaaaaaaaaattgggttaaaaaatgggggagaaaattcaatatagtctttgttgcacagaatgttgacataatcattattttctcagattattaccattaatttgttatcataatctttgtttttttttgtgcatgttacagaatataatagaatgtaatgtgactaaaaacagtaggagcaattaagagtttcccatgaattaacttacagtaataataagagcatattgccaggcactgtcctaaatgcatttgtttacaatttcacttaatttatttgacagctatgtatattcagcacctactgtgatctttgcactgtgtcaagacttggggctattactctgaatcaaatcgacatggtttctgcatgttgccataccctagatagaaatcagggaaggttctctaaaggaactttctaagccaggacctgaaggatgagtagaagttagctgaggtgagagtgggaaagggagtaggaagtcctctggggacatgacaacgaccttgaaagtatgtgagtgaaaggaacattaaaataattgaaaaatatatgtagtatactaaagcctaatgtgaaaggaatgaggcaagaaagaatttggggaggttgccaggggccagatcacaaagggctttgtaaaatgtgttgttatagaatctggattttatgccaaggatcatgggaagccattgataggtttagagagagattttgtttgtttcctcagactgtgttttagaaaagtcactgactgcagtgactaggaggagtgtagctgggaagaagtaaaggttgacctaggggtaccaacaataaaggtcctagataatgatatgaattcagtgattatgggaatgaaaagaagtatttagaaatacttatgaggtagatttggtgactggatgtggagtagagggaagagcccaagacgactgactctcagatttcctacctggagtgctattactgaataggggcctaagtggaggaacaggtttgagaaggaaagtgttcttgtcctagacttgcaaccaattcccagtgaaaatcctgtatctctttgtattatctagtatttgaaatgacattgtgtaaaagtgactcttgtttagtaaaattcagtcaaatgtagcaatgctgccataacctgaatttacaccttgaagctgaaagattgtactttagcatttagtgatctgttactgtagttaattttatgaaacaatttacttactgcttaatttttaaaaattacttgaagagaataatggctaagaagccatatgtgaatacctatcttaagccttttattcacatataaagtaactttataaccagtgtttgtccaacttttaaaaataaagttcattaaaataacttataaaaaatattattttttgtctttcatgactctagtaagtagaatgtttacatttatgctagagatgaaaaaattaagtaggataactactttaaaataagtctgtctttcaccaggtgtgcacatgtatcaaaacatgttgtatgctataaatatatacaattttatctgtgaattttaccttaataaagttggggcaggggaatgaaacatctcttatgtgttctctacaaactgaatattcttttactttgaatattttgtaagtttaaaagtactttacaacctacttttttttttcttttttcttaggcactacaagggcccccagggatggagaagtaccaggagtggattataatttcatttccgttgaacagttcaaagcactggaagagagtggagcattgttagaaagtgggacatatgatggtatgtccccaaataacatcactaccacccaaaaaactatctgaacgactggaattatttcagagggaatttgaccagtaaagtaccactttttgaaaaactttttttcctctctgtttttgagaaaattttcttttgatggggagatttgtaatttattaattaaaatgggattaaataataagcaaaaaaaatccatcatattttaaagttgattgtgaacagtatactaaaaatcagccagactggccagtttatatatttcatagtaattcacattcatcatgtgaactcagtgagtatttgttgattgcattttatttgtggttggaattcaaaatctgtactttaaaaaacttacatgtaccttgactatcctggaaaaaagagaatataaaatttggggagaaaacaacaaaaacagaataattggttttcttttcatttctgtttcctctacccacttgattccattgatatttgatatttgagatcaatttccatttttaaatgactctgttagatctatttttccccttatgtaacatacccttccctggcaagcttatccacttccatagcaccctacgctatggtccattattgctttttcatactattataattgcctgtttataagctctgtgatagtaatggtcatgtctttcttacttgatattatcttcagtgcctaaagatagtgttcaataaatatctaacctggaattcagcgtatctaaatatgcatttgtgttctatccaaaagagaaattcttcatcatttctctctttagcagcaccatgatctcagaacagtgaaatcattatttactttctcctttttctcacatttcacatccatttgccaaatctcatcatttcttcttttgtagctgcattcacaatacccttctttcactttcaccacctcattgtaggcccactagaagagctcatgtgtggactattgctgttgatctcatttgttcccatttcttccaccctgcccattgctaccatgctagtcttcttcaagagcagctttatcatgtctctctcctattcagaactttcaatgatttcctttcatctgctaagtttaacctaactaccttttctgggcttagcgcccatgactcattcatttgttcattcgttttatcctgttttattcattaaacaaccatttattaagtacctactatgtgccaagtactaaaagagaatctcggaatactgtaatgaacaagattaaagtgcttttgaagtttttttttgtttgtttttgtttttttttaagaagccctctccccttaaatgatgaagatgctctacattttcttccactaaatataagagcttggtatggacgaagtggcatattacttattattaattgctgtgtgctcaattcaaagaaaatgcaaattaaaatagttgtacattatttcacatccatagattggcaacaattttacagtctgataattgcaagaaatggaaactcccatacactgctggcaagactataaaatggtataatccttctggagagcatcgtggcagtagctggtaaatttgaagatatacataactctgacctagcagtgcccctctctagacatctactcaggaaaaactgttgcccatatgcatatgtagacacatatgggaatatttgttatagtgtgaaacagtgacagaatggaaacaactctcctttagtagaatgaataacatacattttaatttgttcataaaaatggactgctatacagcagttcaatgtactggatttataggtatcaacattaataggtcttaagaggcataaaaagtataaaattatataaaggtataaaattgtataaaaagaaagttacaaaaggatatgtacattatactatttatgaaaaaatatgtgaaatattgtgaaaatactctgtgaagcttttatgaaaacaatagtatttacatgttatagatgcatatatacatatcctagatgtatattcaggaggaaagacacatatcaacttcaggacagctcagggagggagtggctatagggacaggaagttagagctttaattgtagatgtggccatatatgtatatatccttaaagagaaaaaaagggagatttgaaagcaatctagcaataatatctagatgatgtatatataaataaatacatgtacatatacttatataagtaaattttatatagatatttctaatactattctgatactacagtctgtaattttatatgtttgaaatattgaatagttggcatttctgcaaaaatgaaaaagccttcagaaaataaaaaaaacttcaaaacagctctaaaacaatgaaaatctttgtcagtaactatagttagggttcacaaaccttggaattgtatactgtatctgaaaacttggtatttaccaacatctcaagaaaaaatagatctaatttattttatttatttatttatttttattattattatactttaagttctagggtacatgtgcacaacatgcaggtttgttacatatgtatacatgtgccatgttggtgtgctgcacccattaactcatcatttacattaggtatatctcctaatgctatccctccccccagatctaatttatttataaacaatgctaatttttttttaatctgagccccataattatctttttaaacaaggaaactgcccaaaattattatgaagtcctaaaatcttttcagtgattatggatggcagttatcatatcctgcatttttatattttccccttagaaaaaggttaaattttctcgagttagataataattaccaagaattctcagtaagatgtgtttctagtagtactactaccttacttagaaaaagtggactttttatttctgtcatggtatatccagtttccttgatactgtgattaatgggcataattcaggaaaaatagagaccctcgaacctcctaatccccagccaaatctctgtttggtgtatttctgtgccggctgccccagagaagcgtgactggctttttcattggttctttgctttacttctgagctagaaagtttgcagaaagtttagtctgttttcatacaaatctttgcatccatctgtatgactggagtaactccatttcaaatatggatttggaaacaagggagtaggtgagtagggagagacaggatgtcattgaaaagttttttagtttcattttattgttttgtcttcattattttaatgacaattactgctgaaagtcaaacttccaaagaattcatgttaaatgttttccccctcaaaacatgcacaatttaaggtaaactatgtaatgtctagatttgtctcagcattatggggaagaacctatgctattttctatctaggaaaaaacaatcaattatctacctcattaatttaccttaggtgaatgagcatcttaattacttccttaggagctaaggaatttgattagaaaatatgattttagaaaaatcatgagtattttactctctaatcatatatatatttctctaacgttagcataatgattaatagaatgtcaaaagtagtaggaaccacaaactgttaatgtggctagacctgttgagtgctttcccatattatttggcggcctagtgggaactgcatgacaaattgagaagatactcaattgttttcattcttttctggaacatttatttttactgcaaaaattacagattctcaagagaaagttaaagtatttcttgctttcctgagagtaagccaatactgaattatcctgctaatgtctctgtttgttcaataaattgtcagataaaataatagaatgctcagaaaaacttttaaaaattacccttacataaaaagcctacatttttatatgatctggttagttcttagcttaacctttacctacatacttcctcattttaccaaaatagttcattatgttacacattagaacaaaattatttcagttagttttatcctcatttacccccaccttttatgccaattagtcttacatgacagcatcaatgcatttaaattcacaaagtatgtcctaattcagaacccatgtaaggcaatccctgtaggaatgaataatctacttacatacagtcaacttcctggccttaaacaaatagtattaagatattagataatatatgtgaagagcacttgagaaattagttctttcccctatttctgctctctcttctcgtaagatgagtgctttgagcgctttggcctccttttggccaatggtagatatttccttttttttttttttttttttttgaggcagagtctctgtcacccaggctggagtgtagtggcgcaatctcagctcattggaacctctgcctcctagattcaagtgattttcctgcctcagtctcccgagtaactgggattcacaggcatgtgctaccatacctggctaatttttgtgtttttagtagagatgggttttgccgtgttggccaagctgatctgaaactcctgacctcaaatgattcacccatctcgacctcccaaagtgctgggattacaagtgtgagccaccatgcccacccctatggtagatatttcaaaacttctttgtgaaaaacagggcagagacatacactaggtcaaattgctctgactctcactgcaacattagtaatttcagctgctattttattcacttcaggaaacttctatggaactcccaagcctccagcagaacccagcccttttcagccagatccagttgatcaagtcctctttgataatgagtttgatgcagaatctcaaagaaaacgaacgacatctgtcagcaagatggaaagaatggatagctctcttcctgaagaggaagaagatgaggacaaggaagctattaatggcagtggaaacgcaggtttgtaaatagatgaacaacttctaactgatcttctagattgattttactattacgttgaattaaaagcactaaaattttttacaaagcatatggagagcaagtgatgggattttaatttttttgtaaaggttgtatgtggagcaaagtgtatttctgtagaccatcctataagctaaagtgagttgtcccaatttggataaatcaatgataaactatcattagtaataaaatatatgccattaccctgctgtttaaaatatttgagatttgcctctgatgttgcaatgtgggagtcttgttggcctatgtcttactttacaggatgtaaacaatatatggatgttttagaatgtagacttcagcctaaacaaagtaaatagggcttgaaagtatgctgataaaaattatctaaaaggttggtttataatattttgaatttaaattttggattcactcaaagaaaaatttcaaatatgagacccttcattaaatgtaaaaccaacagaaattcagtggtgaagaatctgctccttttgagtagccctaattaatgtggtgattgcttagagggttattagacttataactgagagtataactaggaaaccatagaatcacagctgagcttattcaatggtattcattgcaaaaattccattcagaacactagaatgtaaacttcatagggctgaagttttcctttttttatgtactgttctatcccttccatcaaaaacatgcctggcatgtaataggaactaaaatcctcaaatttgcagaacacatttccttatcattttcccaaagcaccctaatctttttcatcaattattaaaatgtgatatgtatatttattgagttaatacattcattgtttatgtcccactccagagtgtgagttctgttttatagtcctatctttcacataatacgtttaatgttaaatggattaccccaatgtatttaaatgtaaatactaaaaacaggttttaaaaggtttaggtgaattcacatctaatttttaggagttcctaagggaactcatcacaccgttgagccttttaatgttgatatcagctttgctatcccacaaaattaagtctgttaacatttaaaaatgctaaacagtaggattggagaccatgaatctttcccaatatgggaatttatatgttcttgatttaagggaaaagaaaatgttctttttttacttcctaatacagagcctttaattgatcactgcagttcttttagcggtaaacttgtttgtaatctctatagttgatgcttcatgtaagtcacttgttaaactgatgttatatactctttgatgttaatatttaaagggaatatatccaagggtgtgtgggaggcagttcgtatactacctcttatgtatagataccataggacacttacattgaattacatatttctttgtcatagaaaatatacaggacatttaagtgaaaaaatacaaagcacccgcctacaaacagaattcaccttctgaataagtatgaactgtagttgttagttaactaatcaaagttggggaaatatgctttgtgtgttgcttttgttgttttttgtttatttgtttgtttgtttgttttgagacagagtctccctttgttgctcaagcaggagtgcagtggtgcgatcttggctcactgcaatctgtctcctaggctcacacaattctcatgtctcagcctcctaagtagctaggattacaggcatgtgccaccctgcccagataatttttgtatttttagtagagacagggtttcaccatgttggccaagctggtctcgaactcctggcctctggtgatccgcctgccttgacctcccagagtgctgggattacaggcgtgagccaccgtgcccagcctgtgtatcgctttggaatccctgccttgaaaaatcagaaaattgttcgggagtagaaatgaggagaggataggtagaggtttatttgtgcacaccagtatgtttattattttatatcttgctgaagaaataacccaaaagaaagttaaaatggtcatgtacaataacatatgttacgtaataattattttttttctaagaaatggttttatataaagaacatcttcccaagtcattggctattaagcaaactcctttattcaattgcttggaactatattaagaaaagtgttatagatcatatacttgcttttacttttctccaacatggttatttcccaagaatgtaactcctttccagattgatttttccattaggtaccttttaatttctatcattttttctgcatacaaaataaatcatgtgtttgattcatttatttattcaacaaatatgtagtgagcacttactagaatactaaatgccattgtgctaaatgctagcaataaagcagtgaacaaaacggacaaaaacctgtcatgaactataccttctggtgggagagacagaactggccaacttaaatgaataacatacatcgtgtgttagatggtgctacagagaaaaatgaagcagagcaggaggtggtaagatgtggtggtcaaggtttgcaattttagacagtgtggaagaaaagacttgaaagaatcaagtgagtaaactcaggatatctgggagaagagcattctagacagacagaactggaggtacaaatgcccagagatgggaacatacctagaatattcaggcaatagcaaggaaaccagagtggttggatacaatgtggacaatgcattctatgtggttggagcagagtgatggaaggcaatagaatagaatagtaaccaataagatcatttagataatgatgggcatgaggagggaagaatgtatataataaagcatcttgtaggtcattggaagaattttgatttttattctgaaatgagaaacgattatggggttttgattcaaagagtaacatggtacaacagtttttaacaggcttattgtgactactgtattgagaataggcaaaaggaggacatgggcaaaataccctaactgggataccagttaggaggttattgaatgtgcaaggaagaaagtgatcagatgctgctgataactcaagtaggatggaactgagaaatgatcattggatttagcaatgtagaggttattgatgaccttgataagaatagtttaatgataggaattcaaaagccttgttggagtgaggtccagagagaactggaagagtggaagtggaggtagcaaatataaactctttcaaggtggtttggtgtaaagaggagagaaataggttggctgccaaggggtaaagagaattattttctttttactgaactgggaacatgtttttatgtggttggatatgatctaatagatagagaagattggtgatgcaggaaggagagtgaaagaattgctgtaggcaagagaagatgggatataatttataattggagggttagccctagctaggagtacaaacagttcttccatagtaacagatggtggagtcaatgggcacagtttctgtgtagatgtgatggtgggagtttgtggaagttttcttctgcttgcttctattttgttagtgaaataagacacaaggtcatcaaatgagatgagggataagggaaaagtagtggatggtttaaggagaaagaaggtatgaaataattatcttggagaatgtcagagtgaatcaactaaagaaatgtgctatgatcatcatgcatcattaaatgcccacataaggttagtgatcatgaatttaaagtaaacttgtcaatattgcctgtattcagctgtgtatggtgacatggagtaggtggagagtaggatttaagcagagttctgatttagccaggcagtattatgaagtaaggttagggcaaaggaatcaggaatatttacaagggaataattatagtggttcatcatggaatttaagttgggttagcagggcaatggggaaatgggtagaggataaagaatagtgaaaggtagtaaatagtagggcatggttagataaagaatggttggagttgaaatactatagagaaggatatctaaggatatataagatctctgtcagattctctgaatctgagccattgcctgcaatttgaagttgttatagtgatattacatagcatcgtttaagttttagaaacaagttttaagtacacgaattgtgaactccctagacagtacccaaattttagtattcttacctacattatgggctttgggactctaaaaggattttaatattactaaacagaattatatttaacaacaggaactctattgagtgtaatttttaaaaattactattatttaaaggccagtgttaaatgtgtacaaggcagcttagtatagcaggtgagagcatggaccacttagattcagttcatggctttgctgtttattggcagtgtaattttgactaagttaacttaacctctctgtgccttagttttctcagtctataaaacaaggagattaataatagatactcacagggttgctgtgatgattatgagttaacatacagaaagcacttaaaatagagcctgacacataaaaggactacattagtgctgctgtagctgctgtggcttattaggatttatactgaattaattctattgttgttttttgcttctttccaagactagcatcagaggtgctatacagagttaattgtcaattactaggggaaaagagttgaatatgttggttattttaaaatttatagcagaatgtggacataatagacaagaaatttgccatatttatgtatttggaatttttttagaaaggaaaggtgctgtttgaagaagaatataactttacccacttttcacacctttctgttttgaacaatggcagaaaacagagagaggcattctgagtcatctgactggatgaagactgttccaagttacaaccaaacaaatagctccatggactttagaaattatatgatgagagatgagactctggaaccactgcccaaaaactgggaaatggcctacactgacacagggatgatctacttcattgagtaagcaaatgtctctatctcttctaatgtgccctaacatgttgaggattgtctaagatttttttaaacctcattttagacacatacctttttcagaagactcattttttttctttctttaaaaatatttttcataaaactgacagttgatttttaatcagatttaatctgacacttcatttttatttgacttggataaaggaatagtgtatttgacttctggttttataagagcaggaggatcaaaaacagttcacgaatggtgaaaaatgtaaagaataaagggtattttgcttggctttttaaaaagcttttaggtagattgtccagcttaatgagatttcaagaattgtcatcatgagtaggagcatattattatccgaattaaatattttcagtcctggagtttgagtttgatgtgttcaggcaatatagttgaatgatgtaggaagaaaatatcactgatcatcagagtaattggtacaaatttaagttcacaaaaaacattatttttatggaaaagcactattaatataatatttatagagatactgattaccatatatattagatcaacctaaaattgtatgttgtttgtactagagaataatattatgcaaataattattggaagttttatcatgaagaatttttatattctcacgtagctgtaattctcatcgtaaagtaatttgcccaaaggtagaatattaatgtagtaaagttacagaatataacaattaaataacggttaaaatatttggatctaggcactacactcaaagaacatatactcagaaatgaatttggagtgggagtcttgaatctgtttcctcagatggtcccaattccgtacccttccaaaagagtgagcgtcttgctataccaaataggattctagtttttaaaagacacggatctttggatgtgtagcgttctttttactatagattgcacattattgatgaggttatacatttatataaacattcatcaccacaattatacaaagcaggtacaaccaggtggtatattcttctttattgacaactttaagggatttgttaagggaaatttagacttttgactttcatgctgactttagaactaagccccaaaataaggtgtagagtcattagaagtagctaaaatatctttaaaaacagattatgagacatttaatctgacagtacttcaccctgcaaacagggctaagttagtaaattaaagagggagaatttataaaaagaaatatttttatagtttaatatatgtaaatggatgaaagatctaaatgtaagacctgaaactataaaaaggaagaaaacatagggaaaaagctttacaacattggatttgccaagggctttttagatataacaccaaaagcacaggcaacaaaagccaaagtagacaaaaatggactacatcaaacttaaaaatttctgcatagcaaagcaaacaatcaacagagtgaaaaagcaatatatagaataggagaaaatatttataaaccatatatattataaagggttaatatgtagaatatagttaaatatttgctgctagataaagctgtttggtttggtataaccagtatggttgatctgtattactgctgctgttgaaaaatgcaactgtaagaaaataatgttcatataggtctatagactttagttcttatgttttgggaatatcccctatggatatttcttttcattggaaaattttgggtaaaattttagcaaattgcctacatctgctgatttagcaataaaattttggatcatgggaacctaagttaagcttttctcaagtggcagtttttagttgggtttagcaaggtattttcgtgttgttgttgttcttattgttgtttcctaacaatctatgtggctcctaggcccctgagttctcatcctttgcattttctaaaatttttttttaagcaaaaaacttttaagtttggggagattatttctctaatagcatgagtaatatagactttctagagataatctcacttttttctacagaaataagctattattcagcatattaaaaactgttttggccaggcacggtggctcacgcctgtaatcccagcactttgggaggccgaggcaggcggattatgaggtcaggagatcgagaccatcctggctaacatggtgaaactctgtctctactaaaaatgcaaaaacttagctgggcacggtggcgggcgcctgtagtcccagctactcgggaggctgaggcaggaaaatggtgtgaacctgagaggtggagcttgcagtgagccgagatcgggccactgcactccagcctctgtgacagagtgagactctgtctcaaaaacaaacaaacaaacaaaaaagtgtttctatcacattctaccagctagtattatacctggcagtggctgcagagctctgcaagtagctcagcggttacaaaagatatagaagatgtgagtaattccctgaaaccttattggcttcatttcctaagagtggtcaaggtacagattagtgagtttatttcatgttaaacacactcaggaaatataacttgtttacattcattgttactaattaataacagttaattacttcagttaagtatgacatggtattccaataataactttaggcaagagaatcacttgagccgaggagttcaagaccagtctaggcaacatagccaggcctctctctgcaaaaaaaattttttcagttgttaggcatggtggcacacgcctgtagtcacagccacttgggagcctgaagcaggaggatcacttgagcctaggaagtcaaggctgccgtgagctgtgatcatgccactgcactccaacctgtgcaacagagcaagactctgtctcaaaataataataataataataacaataactttaatttacattttattcccttcctatgtattttcttccatgactttttctttctttaatatccttgtatgtcagatatttaaactaacactgtttgtccactaagcaatgagatagtttcatttcggcgttagtatctgctgcatggtgacctggtctgaaactaactgactatgacatataatgaaattaaacagatactgctctctaaagtcatctttggcctatatcataaaatgaagcaggggcaggatatttttattcctcccttttttcctgtgtggatcatgctgatgaaaacttagttttgtagagcagagtttaactatacctgttgtttttacttgcatgtggcagaaacagccactttaaaactctttgttttattttattctattttattttaaagagtccctgagggcaggagctctatctgatgtttatttatctttatattccagcttcccacacagtacctacgtatcacaggcacacaagaaatatagtactttttgaagggaagaagaaaggagttcagccagtgagcaaacaaggttttcagtgcagtattgttggctagataatgcacagtatgtggctatgcgcccaccttttgaaacatttttaactgcttaaatagtgtctgttattccatacttggcattttaggccttctttaaagtctcttgattctcaagttagtgcctctagcattaccattcctttatggaaattttgaagtagactgagaacaatagggttaatgaatgaatctgaggaatacaaatggagcctgttggagattaatgttcaaacatcatgtcttttagtcacttttaatctttacttttgaaataattttctcctcctttattttactgtttctaattaaaatctttattctacagccacaataccaagacaaccacctggttggatcctcgtctttgtaagaaagccaaagcccctgaagactgtgaagatggaggtagagattcagaaacttactctatcatacttattctcttaatcctttcttgctcttcttgctcagataatgggtttttcaaaaccctaaacaaaccataatgtacacaagcaaaaaagcagtgggtggatatcataatcaactgattgtggtaattatgtcattacatctaactttatgagagatttcatttctttttcaggattacataactctctataaaaaataacaacaacactaaaatacatttgcccttttttgacatctgtcctgaagacagacttttaaaattctaaataaatatttaaaaattaggcacatcctcaaccataagctaggtctatcatgtcttatgaagtttttaaagtatatttaatttagtatacattacagtagatatgcaagtatctatagctattcttagccatttacagcagcagtagaaattcaaggaaagtctttaatataggcccccacacatatacacacttactttttactgcttaaaggaaaaattatttctctaagaatcatcagataatagcacttatctgtcctatatattataggttatatttaacagtgtagttttgagctgggtgtggtggcacaaacctgtagtcctaaagctatatggggagctgaaatgggaggattgcttgagctcaagagtttgagatcacagtgagctgtggtcatgctactgcactccagcctgggcaacagagagagaccctgtctctaaaaactaataaataaacaaattgttaaaaagagtagagttttgtaaataagtatagaatttattccatccaaaattgtttgctatgtctttaccttaggagatgaataaaatttgcatttttgtattactaatcagaaactatgtattaattggttttaaaaaataagtggcgtaaaatgaggttcacagtagtcctccttgtattgaagtccaatctataaaaagaaattaaacagaatttccacatatattgttcagcatgattataatataatattaagagttttctaggaagaagcaatcagaaaatggaattgtttaaaattccctctacaatggcatcaaaaaagttagatagcttgaaacaaatcttctgaacaatgtgcaagttctcaacactaaaaactacaaaacataattgaaagacataggaagacttaaaataattgacaagaggctgggcatgatggctcatgcctgtaatcacagccaaggtggatggatcacttgaacccaggagttcaagaacagcctgggcaacagggtgaaaccctgtctctactaaaagtacaaaaactcactgggtgtggtagcatgcgcctgtagacccagctactcaggaggctgaggtgagaagatcgcttgagtccaggaggttgaggctgcggtgaaccatgatcacgccactgcactccagcctgggtgacagagtgagaccctgtctcaaaatactaatactaatactaatactaataataattgacaagatatattctgttcattagccaaagaaccttaaaaaaaaaaagacaaagttggaagacatagggtaccagatctgaagacttattttagagctacagtgataaagacagtttggtattggcataaggatagataaatagatcagtggaacaaaatagagagtctagaaatcaatacacatgtatgtagtcactttattttcaaccaaagtgccaactgatatggaaaaatgaacctcaattatgcctcacttcatacaaacagttaatttcagatgaatcaaagacctaagcataaaagctagaaccacaaagcttttggaagaaaatataggagagtgtcttcatgagtcagaattggcaaagatttcttaaacaggccacaaaaaatatgaaccatagaagaaaaagttaatattttgcatgtaatagaaattttaaaattctcttcatcagaagacaccattgaaaaatgaatagacaaagtcacagactttgcaatatatatttgccaaaggaattaaattcagaatctataagaactgtttacaactcaataatattgccaaattttaaaatgggcaaaatatgttaataaacatttcaccaaagaaaatatacaaacagcccataaaaacatgaaaagatatttaaaattattaatcattaggtgttttgcaaattaaaaccactgtgatctactactttacacccactagaatgagtataacaaaaaaaaaaacagatggtaactaatcttggggaggatagggagaaacagtaacccttgtacattgctgtgccattggaaaatggtatagccactttggagaacagtttggcagtttcttaaaaggttaaatataaatttaccatatgacctagtaaattttctcctaggtatctacccaagaggaatgaaaacaaaagtcctcataaagacttgcatgcaaatattcatagcagcactattcataatagccaaaaagtggaaaccacccaactgtccattaaccaatgagcagataaatcaaatgtgctataacctacaatggaatactattgagcaataaaaaggaacaaaatactatacatgctatatgtatgaatctcaaaaacatgctaagtgaaagaaattagacataataggccagatattgtatggttctatttgtatgaaatgtccagaataggcaaatctgtggaaacagaaaataggttactggttgccttgggctaaggataagaatagagattaactgttaacagcatgaggaatcttcttggagttatgaagacgttttaaaactggattgtggtgatggttgtacaattcagtaaattattaaaaattattgaactgtatacttaaaacagatgaattgtatatatgtaaattatacctcaataaagttgtttttaaaatggccaaaggacttatgcacttcacaaaagaagataaaagaagagtcaagaagaacatgaagaggtgcttatcattagttatcactacaatgagataccatcaacacccactacaagggctagagataccatctacatcctttagaaggactaaagtacactgacgctcagcagaaaccttacatgccagaagggattggagttctatctttaaccaccttaaacagaataagtgtcagccaagaattttgtatccagcaatactaagtttcataaatgaagaagaaataaagtatttttcagacaagtaaatgttgaaggaatttgacattaccagatcagccctacaagatatggtaaaaggagttctaaatcttcaaacaaaaagttgatatgcaccagaatagaacctcttgaaagcatgcaacttacaggactgccaggcacggtggctcacacctgtaatcccagcactttgggaggctgtggtgggcggataatgaggtcaggagttcaagaccagtctgaccaacatggtgaaaccccatctctactaaaaatacaaaaattagccagacatggtggtgggcacctgtaatcccagctactcaggaggctgaggcaggagaattgcttaaacccaggaggtggaggttgcagttagccaagattgcaccactgtactccagcctgggcaacagagcgagactctgcctgccatccccccaccccccctccaaaaaaaaactcacaggacctataaagcaatagcacagtaaagaaaacaaagtactaggtaacaatcaacatgatgactggaatagtaccttatatctcaatattaatgttgaatgtaaatggtctaagtgctcacttgaaagaagaagattggcagaatggataaaaattcacaaaccaaatatctgctgtcttcaagagattcatctaacacataaggattcctatagactcaacgtaaaagagtggaaaaagatatttcacacaaatggaaactcaaagtgagcaggagtagctattgttatgtcagagaaaacagattttaaagcaacaacagttaaaaaaaaagacaaagaaggtcattatacaatgataaaatgatcaacaagaagatattgcaatactaaatatatatacccctaactctagagcccccagattcatgaaacaattactattagacctaagaaaggagatatcaacacaataatagtaggggacttcaacactccactgacagcactagatagatcattggagcagaaaatcagcaaacactggacttaaactacactctagaacaaataaacctgacagatatttacagaacaattctaaccaagaactgcagaatatacattcttctcatcagcacatggaaccttctgcaaagtagaccatatgataggccacaaaacaagtctcaataaatttttaaaactcaaaatcttttgtgggcatttagtgctataaatttccctctgcacactgctttgaatgtgtcccagagattctggtatgttgtctttgttctcgttggtttcaaagaacatctttatttctgccttcatttcgttatgtacccatgcccacaagagaaagcaggaaagagccaaaattgacatcctaacatcacaattgaaagaactagaaaagcaagagcaaacacattcaaaagctagcagaaggcaagaaataactaaattcagagcagaactgaaggaaatagagacacaaaaaacccttcaaaaaattaatgaatccaggagctggttttttgaaaggatcaacaaaattgatcgaccactagcaagactaataaagaagaaaagagagaagaatcaaatagatgcaataaaaaatgataaaaggggatatcaccaccgatcccacagaaataaaaactactatcagagaatactacgaacacctctacgcaaataaactagaaaatctagaagaaatggataaattcctcgacacatacaccctcccaagactaaaccaggaagaagttgaatctctgagtagaccaataacaggctctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagctgggcagagacacaaccaaaaaagagaattttagaccaatatccttgatgaacattgatgcaaaaatcctcaataaaatactggcaaactgaatccagcagcacatcaaaaagcttatccaccgtgatcaagtgggcttcatccctgggatgcaaggctggttcaatatacgcaaatcaatgaatgtaatccagcatataaacagaaccaaagacaaaaaccacatggttatctcaatagatgcagaaaaggcctttgaaaaaattcaacagcccttcatgctaaaaactctcaataaattaggtattgatgggacatatctcaaaataataagagctatctatgacaaacccacaaccaatatcatactgaatgggcaaaaactggaagcattccctttgaaaactggcacaagacaggggtgccctctctcaccactcctattcaacatagtgttggaagttctggccagggcaattaggcaggagaaggaaataaacggtattcaattaggaaaagaggaagtcaaattgtccctgtttgcagatgacatgatagtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggacatgaaggacctcttcaaggagaactacaaaccactgctcaatgaaataaaagaggatacaagaaatggaagaacattccatgctcatgggtaggaagaatcaatatcgtgaaaatggccgtattgcccaaggtaatttatagattcaatgccatccccatcaagctaccaatgactttcttcacagaattggaaaaaactactttaaagttcatatggaaccaaaaaagagtccgcattgccaagtcaatcctaagccaaaagaacaaagctggaggcatcacactacctgacttcaacctactacaaggctacagtaaccaaaacagcatggtactggtaccaaaacagagatatagatcaatgggacagaacagagccctcagaaatagcgccgcctatctacaactatctgatctttgacaaacctgagaaaaacaagcaatggggaaaggattccctatgtaataaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcaataccattcaggacataggcatgggcaaggacttcatgtctaaaacaccaaaagcaatgagcaataaaagccaaaattgacaaatgggatctaattaaactaaagagcttctgcacagcaaaagaaactaccatcagagtgaacaggcagcctacaaaacaggagaaaatttttgcaatctactcatctgacaaatggctaatatccacaatctacaatgaactccaacaaatttacaagaaaaaaacaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaccactgttacaccgttggtgggactgtaaactagttcaacccttgtggaagtcagtgtggcgattcctcagggatctagaactagaaataccatttgacccagccatcccattactgggtatatacccaaaggactataaatcatgctgctataaagacacatgcacaagtatgtttattgtggcactattcacaatagcaaagacttggaaccaacccaaatgtccaacaacgatagactggattaagaaaatgtggcacatatacaccgtggaatactatgcagccataaaaaatgatgagttcatgtcctttgtagggacatggatgaaattggaaatcatcattctcagtaaactatcgcaagaacaaaaaaccaaacaccgtatattctcactcataggttggaactgaacaatgagaacacatggacacaggaaggggaacatcacactctggggactgctgtggggtggggggagtgggaagggatagcattaggagatatacctaatgctaaatgacgagttaatgggtgcagcacaccagcatgtcacatgtatacatatgtaactaacctgcacattgtgcacatgtaccctaaaacttaaagtataataataataaaattataaaaaaaactcaaaatcatatgaggtatcttctcagaccacagtggaataaaactagaaatcaactcctaaaggaaccctaaaaactatacaaatgcatggaaattaaacagtctgctcctaagtgatttttgggttaagaacaaaatcaagatggaagtgttaaaattatttgaaatgaatgataatagtgacataagttatcaaaacctgagatacagcaaagcagtgctgagaagaaagtttatagcactaaattgctacatcaaaaagtctgaaagatcacaaattgacaacgtaatgtcacacctcaaggaactagagaaacaagaacaaacccaaagttagtggaataaaagaaataacagaagatcggagcagaattaaatgaaattaaaacaaacaaaaacagtaggccagatactgtggctcatgcctataagcccagcactttaggcggccaaggcaggcagattgcttggtaatttgagaccagcctaagcaacatggtgaaaccctatttctacaaaaaatacacaaattaaccaggtatggtggtgcccacctgtggtcccagctgctccagaggctgaggtgggaggattacttgagcctggaggaggcagaggttgcagttagacgagactgtcccactgcactccagtctgcgaaacagaacgagattgtctcaaaaaataaaaaaaatcaaagtgtgtgtatgtgtatgtatacacatatatatatatgtgtatacatacacagaagatcaaagagacaaaaagctggttatttgaaaaagatatacaaaatttatagaccattagctagattaaccaagaagagaaaaaattcaaataagcccaattcgaaatgaaaatgaaaatgaaatggaaatgaaaatgaaaatggagacattacaacaaacaccacggaaatacaaaagataatttgaggctactatgaataagtgaaattgaaactgtgcacacaaagtagaaaatctagaggactggataaattcatggaaacatacaaccctcctagcttaaatcaggaataaatagaaatcctgaaccaataactagcagtgagattgaatcagtaatttaaaaattgccaacaacaacaacaacaacaacaacaaaaagcctgaggccaaatggatttacagccaaattctaccagacattcaaagaataattggtatcaatcctactgaaactattccaaaagattgagaaagagggaatcttctctaactctttctatgaagccagtatcaccctgataccaaaaccgggaaaggacctaacaaaaaaataaaactatagaccagtatccctgatgaaaatagaaagaccccaaaagcaaatgcaacaaaaacaaaaataaatgcgacctaattaaacaaaaaagcttctacacagcaaaagaaataatcataagagtaaactgacaaccttcagaatgggagaacatatttgcaaattatgcatccgacaaaggaccaatatccagaatctacaaggaactcaaacaagtcagaaaaataaataaataaaacccaccaaataatgccaccaaaaggtaaaaagtggacaaattacatgaattggcatatctcaaaagaagatacacaaatggccaacaaacatatgaaaaaaaatgctcatcatcagggatgcgtaaattaaaaccacaatgagataccaccttattccagccagagtaataagtcaaaaagcaatagatgttggcatgggtgcagtgaaaagagaacacttatacactgctggttggaatgtaaattagtacagcctctatggaaaacagtatggagcattcttaaagaactaaaattagatctaccatttgatccaggaatcccactcctgggcacctatccaaagaaaaagaagtcattatatcaaaaagacacctgcttatgtatgtctatcatagcataattcataattgcaaacatgtggaaccaacttaggaaccaacctaagtacccatcaaatgatgagtggataaataaaatgtggtattgccaggtgcattggctcatgcctgtaatcccaacactttgggaggctgaggcgggcagatcacaaggtcaagagatcaagaccatcctggccaatatggtgaaaccccatctctactaaaaatacaaaaattagccaggcatggtggcatgcacctgtaatcccacctactcgggaggctgaggcaggagaatcgcttgaatccaggaggcggaggttgtggtgagctgagatcatgccactgcactccagcctggcgacagagtgagtctccatctcaaaaaaaaaaaaaaaaaaaaaaaaaaaaaagagaagaaagaaaatgtggtatatatataccatggaatactacccagccatgaaaaagaatgaaataatgtcttttgcagcaacttggatggagctggaggtcattattctaagtgactcaggaatggagaaccaaatactctatgttctcacttataagtgggagctaagctatgggtacacaaagacaaacaaagtcgtataatagacattgaagattcagaagggaggagggtcggatgggggaagggataaaaactacatattgggtataatgtacactacttgggtgatgggtgcactaaaatctcagatttcaccactatacagttcatccatgtaaccaaaaaccacttataccctgatataaatatacatatataatatataatatatgtaatattatttttagatatagtaaaataaaatatactgacaataccaaagattaatgagattttagagcaactagcattttcatttattgtgagtggggacacaaaattacctgaacattttttagaacttttcacagtttcctatgaggtaatatctaaagagaaatgaaaacatatgttccccaaaagacttaactagaatgattatgacagcctttctcttaatagctcaaacctggaaacatcccagatatctatcaagaagagaatggataaaccatttgtggtatattcatgcaataaaatactactcatgagtaaaaagaaaaaagtgttgataacactcaataatatggatgagtctcagaaacatgttgtaaaagaaaccagacaccaaagagtaggttctcaattactcattatttaaagcttgagaacaggcaaaactcatgtgtggtaatagaaatcagaaaatgactggggagagtagaagtggggtaaagtgagataattccctggaatgctatattctccatctcaattgaggtgacagttacacaggcatatccagttgccaaaacccactttttataattgaacaagcactcgattttttttttccccgagacggagtcatgctctgtcgaacaggctggagtgcagtggcgcaatcttggatcactgcaacctctgcctcctgggttcaagcgattcttctgcctcaacctcccaagtagctgggactactggcacatgccaccacgcccagctaatttttgtatttctagtagagacggggtttcaccgtattggcgaggctggtctcgaactcctgacctcgtgatccgcctgcctcggcctcccaaagtgctaagattacaggtgtgagccactgcacccagccagattttttttttaccattaaaagggcacttaagagttgtgcattttattgtttgtaaattatacctcaattattattctttttttgagacagagtctctctctgtcacccaggttggagtgcagtggcgcaatctctgctcactgcagcctcctcctcctgggtccaagtgattctcgtgcctcagcctccccagtagctaggactacaggctcatgccaccatggctggctaatttttgtattttttggtagagatggggtttcatcatgttggccaggctggtctgaaactcctgacctcaagtgatccacccacctcaggctcccaaagtgctgggattacaagtgtgagccaccatgcccagcccaagaaataatttttaaaataatttttataccgtagttgtttataaagctttccatagtaagttccttcttatggtgaaatcagccattctaaaggcaaactagaatatataatactatagaatttgactttttttattgtgaacatggtatttgtcttctagagcatgtcccttttactggcttccattctttttcctggtccctaattgtttcagttcagttttctgccttttcttgttttcttttgtagaaagcatttattctcatagctttatcagtttactatagcctgccccattatcaaaatctctagtattgtcctttgttctgaattatatttctgtttcctcttgcttttgagtcttggttttgatttccctactaatacttcaaataagcttatttaaaactaaattgacatctttctcctaatacaacccgtccctctttctgtcatatacgtaccattctcataatcatctatgccaaaatctttgcaattatgtttgcctgttcctctcttcttgctctacttcctgatttagttttcacgtcctgttgctttttcttttttctctttttgccaatatattattatgcaaaagtttcaacatataggaaaatgaaaagaatcatacagtgaacatacatatgcccaccactaggatattacaattaacattttgctacatttgcttcttcacatgattattcatttattctttctctatctgtgatttttcttttatattatatattcctttccattctcctaatcactacacacttggattattcttggtctttcttcctccagttatttctctctctttaatacatcttttatgccagtggttttcaaaatgatcatactcaaactatctactggtacccagtagaaaatattagaactaatttttcataatgttgttactgaaagaaaaagaaacaaactaagcttcactactattttacatacagattggtaatggcattcttactgattccgtatgtcggattatcacatactctaaccagagtgccttgagggaggaatggatgagacacctttgctcttttttcaaggacactgtgaaattttacagttgatttgtgcccagttaagtggatttatagactagttatatagtttttaaactaacctcacataaaatggaaatgtcactttaaaagatttctacaaaaacactactgattgaagatgatacaaataggcaaacccagactaatagcaagaaaatggaagaaccgatactgtttgtgtatcatatatgaccatatataagcttttttcaacttcaaggtaaaatcatgataattgcttgtttaatcacctcctttaaaaacatctatttttgtatatgttttattatatacatattagaagaggggcagatgtcagattttttactaaaaaggctacatgatcaaaaaaccttggagatattatgtaagaccaaattaatctttctaaaactaattttctatctatctctcccttgctgtccattgtcagcagagtaaagtccagactccttggttaagtattaaagattttttataattgaatcatattctatatttatttttcaaagtattctcatgtcataaatctgacatatttttcgtctttgccatatacccatttcttctgccaggaatcagtcttgtttcctgtgtctacctggctcatacctattatccttcgaagctccaatctaaagtataatttctttgtagccccttctgtcattttcttgcaagtcagaagtagacgtcctctcctctgtgctcagtagtaccatatgacatgtctctcttgtagcagttatattgcattgtaactagataccacactcagagcaatgatttttgacacattcatctgtatatcctttcagtagagacttcaatgtttgaaaagagggaaagagggaagagagggagggagggaagaagggaaaaggaagagaaagggaaaaaaagaaagaagctactctatcctccagattattttggtcgcccttttggaaatacttttcaatctctataaggctctgaggggccaataaataataagcccgtcttcattcaccagtttatagtcaatagagaaataagacaccagagacagacagatgaagtcagaatgtcagcaaatgaatgttagccctgcatgtacatggccttgctgttattttacccctgcaggagggagacatgagtacttagtctttggcctctgtgttcaactgcaagcctcctcccaacgggcagacatggcagagaacagaccagaatacgcctctgcaggcaggctgttaaccaaaacagtgagagaactcaagagtccctgagccaagcatattgagttcattgtgtaaaactccccagtcagataagacattctttcttccttggggaagaaagtgaaggggctccgagaaactggaaatgttcctcccattctttattctctaaggaatttgaagaattggatgaacatttccccctaatgctctttacattaaggctgaacatatgtcttggttggcccaggactgatccagctttttcctgttgccccaacataattattaatagtatccccttttattctcaaaagtggacagtacattttatgatcatcctaagtatatttttcttaaaatagaatgatcaaaattgcattcagtattctgggaatgtttgaaactctttaatatgggctactctcccacttacaaaactgggtacacctttttaacattgcctatacttatcttcgggggagcctacaatttagaacattgagtctatttgttttatgctcagccagccttttccactttcctctctacactttgtctccccacgtaatagccccacggaagactattttcaggatgaactatgtgtgattcatattagtattctctgcagtgctttgcacagagtagatgctgaaaagagaagaataatattttaagtgtaggttttataggttaagatattgtttacattctgctgaacatttaagatcttctagaaagaccttacagtttctaaaacatgcccttttcttcccagtcttctgatattctgaacacagctgtgtattcaaatacagtgtaaggacacagcttgaacagcttggtttaattgatgtacattttatcttctattcaaataaaatagtgttttggttaggtagttgtcttgaaaatacaacattaggaattcgttttaccctcaacccatcccatttctcttatgatgaaagaaagattaaatttttgctaaaggcagcttacaaatatattgaatgttgatatttcagagcttagagaatgattaaaaaaattatcaactgaatagagctccaccatgagaaaataattgtaattcttacatttaaacaagaaaaatcctatttggggaagaggaaagaaagataaattcatgggatttagaaccaaccagctgcttgatatgcccaaaatagttttgtcttttgaaatagctttttaggggaatactttggcttcatacacaggaaaagatggttaggttaggtctttcctgtatcaaaaataaacaaacaaattttctcttggccctaaccctccccatagtttttatactatcttttccacaagcaaatttttgttttaagtcatctattcttaaggactctacttcgtatttttctcttcagttactacagtattctgacttttgcctcctaccttttcagggttaccagtaacctcctgatcttatagactctttttagcccttatctttatgcctaacagctttacaaagcgtttttttgtttgtttgtttgtttgtttgttttgagacagagtcttgcactgttgcccaggctagagtgcagtggcgcgatctcggctcactgcaagctccgcctcctgggttcatgccattctcctgcctcagcctccccaacaaagcgttttttaatgctgaccatgcccttcctcttctgtcttcttttacaccattccccctgatgattcttactttctccatctgccgcttaaaatgttagtgctcctaaggttctgttcttcacctttctctgctcagtttatctaggtaatcatgtctgctgtcatagctttaactacaatgtctctcaaatctttatcttcttatatttctctttggagtaccgggttcatacggccaagagcttgttatttatctgtaccaggatgttctacagatcactcaaatgtaacaccttcccttcctgccttcaacagatatgacatccccccagctgcttgagccaaaaactggttgtcatcctcgcctttccctcactgtctcctctctgttgcagttaactaccaagttctatcaattctaacttttaaaaacctgccattcgggtggatcacgaggtcaggagaccaagaccatcctggccaacatggtaaaaccctgtctactaaaatacaaaaaattagctgggcatggtggcacgcacctttagttctagctacccgggagactgaggcaggggaatcacttgaactggggaggcggaggttgcagtgagctgagatcatgccattgcactctagcctggcgacagaggaagactccatctcaaaaaaaaataaaaaataaaaacctgccatttcttgagtgtccattggtggtagacacattactaggcacttttaatatatcatctgtctcctaaattcctctaaatccacattaatttctaatttctattcccacagccattttcataattattcttttttttttttttttgagacagactctcacactgttgcccaggctggagtgcagtgatgagatctcagctcactgcaacctccacttcctaggttcgagcaattctcctgcctcagcctcctgagtagctgagattacaggaacctaccaccacgcccagctaatttttgtatttttagtagagataggggtttcaccatgttgctcaggctggtcttgaactcctgacctcaaatgatctgcccacattggcctcccaaagtgctgggattacaggcgtgagtcaccgtgccggcccattttcataattattcaataaatatttgataatgtatcacttttatgccacaaaagctagaaacctgggaatcatctttgcctctttcctcccttcccttcctcaatcctcatggtagtcattaagttctgttactttaccttctttgttttattatccattctactacccctgccttagttccagtcttcacaagttcttatgcagtctattagtgtttatcttatttgtctgcctttattctcattgcacaccatctatttcgtcctttattactgcttcccataatctttttcaaatataaattaaatcatgtcacagttcaccttaatcaattctctatcatcgtcaaaataaagatcaaacttctcaacacagcactctaagaatgttggaattttgtgcttgttcataaaattcatttccctttgcatacaactttcattctagtttaccaaattatttgtaattatggaaaataccaagcattcttaatacctcaatgccctttaatctatctggaatcatctccctctccctaatcccaacttatttatttatttatttatttatttatttatttgactcggtctatcaccaggctggaatgcagtggcacgatcttggctcattgcaacctccacctcctgggttcaagtgattctcctgcctcagcctcctgagtagctgggactacaggcgtgcaccaccacacccagataatttttgtatttttagtagagacggggtttcacaatgttggccaggatggtctcgatctcttgacctcatgatccgcccgccttggcctcccaaagtgctggaattacaggcgtgagccaacttatctttaaagactgcttaaacatcagcttttagcaggctttcctgatagcaatcttaccaggcaattggtattcctctgcactccccaaaaaagattatgtttatctttatcttatcatttatctcttctgtcttcctgtctagactataaactccttgaagtcaagaactgggttatatttctaatttttatttctgcataaggatgatggggagaggaggatgagaagggaggaaggaaaaaagaataaaatgaataaatgaattgatccactaaatagtgtataaagttgctaggtattttagtcttgatttttattaccttcactttaaatgagcaaataataaccacttctttatctgtattaaattgccctgtgtgaaaacaaaacaaaaccaaacaaaaaaaacttgctaatggtatcagtggtaaaggtgtaaaattaataaagtaacccagaagataaatggctgcatttgtttgccctcctaaagaaaggactgttaatctcttagttgctaattaccttgagtgctaactaaaatgctaaatcaactttcaagttaagattaaaatatatttatgttgatcttttatccttactattagtacatcccttttagtgaatttttcagatatcaaatggactatttcagctatttctatagtccttaatttctccaaacttctctaaagacaaaacataaatctaattgtggtacagttgtagaattcctccttactcagctctattcagttcccatgctatttcaagaaaatttctattaaagaaaaaaatatttttcatggaagatccataactgttatagtgcagttttacagatatattcaaaaaaattactcttatccatgaaacagttgtttggcgataaaatattatatctatttgatagatttgcttcatagctaaggaggattaaagtgaactaaagtacatctcagttctttttaatgttttgttctcttctcacatatttcaactattttagtatttcatttgttctcatctttcccacctgagacatttcaaccaggtccttcaaaggaaaaacacaaaaactcatcaaactttgaaaccaccaatcaatatatatgcagaaaagtatggtggagaaatggggtaggggtaattcagacattttcaccaggaggctagtcatctgttcttttcttatattctgaatgcagaataataatttttcttagagtaaaacagtatagcttgtcaagtttattataatggaatttttacttacaaagttggtatgtcataactgaggctaaatgatataaaactaataagtcttgtgatgctttctaaacctgtttgctgtccagcgtactttttgtgtgtgtgtctttcagcagagcagaagcattcttaagagaaattgaaaataaaagcgtgggacatcatagtgcacaacagtggacttttaaaaaaattcttttttgctcaactgctatataaaatggataggactagaaccacctgctaggaacattcttcccaacttatccatgttttactaataagatggttcttcagaaaccttaactttacaaggaatgcagacaaagtgggagggaaaagattcacattcacattgaaaagctcatgtcagttcatgttgaaaaggctagagatttgttttaactttcagaaattcaactaccttcagtatttctggttatattttattggtcacttactgagaattagtaatatataaaaatgctatgtaaggtatttatttgttatcattcacaaatacagattacacaaagcactgtggtagttagattagtgttccttcagatactcagatcttgttcaccaagagaaagcaggtacttttgtaggttttaagcaaatctagattgctcacttgaaatgacaaaagtccaaggctagggtttcctttgaggagaagtgggtctgaacataacatcaaaaatgactatgtataatagtaaaaaattgaacagatacctgcttcttctattggactacaagggtaaatatgtcttgtgtcagcatgatcaaggtttttaaatgaaagaagtacacagtaatttttattagcatttttatggcttgtggttcatatgaacacctttttgtttaatgccatcttctgttctgggcttctgattgcttgctgaaattctcactggctggtgaagaagccactcagacttaaattgtgtttgttccttgaaagtgagccctcagctttctgacacccaaatattagtataatgaaataataaattcactcactggtgaattcttttctgtcagttttgaatctggcatttcactcaattttctttatttacagagcttccttatggctgggagaaaatagaggaccctcagtatgggacatactatgttgagtaagtttgttacctcagttaatattctcccaaatattttcctttcagcatatagctttagagaatactggatacagcactttatgcttctgtgatccagctgttgagtttttcaactaggggaatgaaaaggtaggggcagtgagcatttgcttcattgaccttgggcttcctggaagttggctttgaatttctaaatatagagaataagggggaagttgcctagacaattaatagctagagatggtattgttactactacagcctctaaagagaaagtcagttgatagaaaactgaaatgagggcaacagactagatgaattatcaaggtcatttccaacactaccactgtatccttctgaaagcagtggaagatctttagggcattataacataattatctgaagttttgaagcatacacctaaaggtgtgctctcttttaaggagttattcaaggaaaacttagtattctttttaggggtgaaagttgcttcttaggcagctgctatggttaaatttaaacataaatatatattggagaggagtgccagacacctgcctatgttagccagagaaattaagctaatatcaatgtctaattttgccttctcttttctttatctaattgctacaatgttatgaccattgggattgctttctttccagatgctaaacactgaatttgacctcaagcgtctagcagcaggcaaatacttctatcagaaacattactatttacctggagactaggagttaaacctgctgcctaggtagcaaagacaaaatgttattattacctgaaaaagtaacaaacacaatcatctttaattttataattgtttcttaatgtttcaacacttataggcataaaccaatgccatttcctggtagttatccctaaagtaagtatctctgactcctgttgcaactgtagtctttattctattgtgcaggttgttacttgagtcactgtggttagagggatttttggaatgacttcttaaaattaaatgtgtctcctaaggaaatgactcaattagattgacacttaagtatataactttagaatttcaatatcttggttcctttgaaagctatgctaattttgtttccattgtgttacttaatgtcttactgatactgtgatgtaaaaagtatacagcagctcttttattattattttttcctaagacttattttgttaaaggaagaaacaaccatttttcacatcaaaggagtatttgggggccgactgaaaaggttttgcaggatttttttcttcccctcaaagtttagtctatttaaattgggctctaatcagctatttgccattgacactgctgaacatttctgagataatgattctcattctctttattatccattccaagtgaatttgaatacatggtcaaaaggtgaaagtcatttgcctgttataaaaccttgagctgaatgatctggtccccattatgcaaagatataatattaaagcaactttagggcaaatcctgaagcgacctgctcctagttgtcagggaggtacatgaaatagcctgaattagaagcaacagcagcagcgacatgattttgtatgattattcccagaatgagctcattttacaggagggttttgtattagactaagaaggagcagactgtactcaagatgcacattagtatggagtcagctgagctgtggagtgtggcttgattcccagattagttaggttttgaatctcgaccatagtaatctgcagtgagtttactgatggagataaaaagctgttacttgaatggctactctttggctctcttagtttgtcaaaccagatggcacgatgattgctcttggcaggagccttgtagtagtaacaccaactgcagtggtagtttttctttgtatttattttagaggatgggattctgaaatggatgaagttattttttaaaataaaatttttccaaaaatgtaatatgcttataatatgcataaatataaatatgcataagctataaatatgcttatatatttagaaatgcggtcttgattatattgcattacatgtctttttaaaattaacatataattatacacattttgggggtacgtagtgatgtttcagtacacgtaatatatagtgattagatcagggtgataagcattaaatgtcttgatgcacctagatgacaaagtcaaaatatatacttgctttcacaactaaaacttttttttttttttttttgagacggagttttactcttgcccaggctagagtgcagcagcacgatcttggctcactgcaacctccgccttctgcctcccaggttcaagtgattctcgtacctcagccccccagtagctgagattataggcatgcgccaccacacccacctaattttgtatttttagtagagatggggtttcaccatgttggccaggctggtcttaaactcctgacctcaagtgatccacccgcctcggcctcccaaagtgctgggatcccaggcgtgagctaccatgcccagccatctaaaactctttatgaaagaatattttgttgagataaatttttaaatccagatattagacataaaattttaatacagaaaatgtgtcaaattgtgtactaatatttaatcattcttgtttgctttgtttctttctgataatctgtaatattctcctctcttatttcccacagctagttatttggaaaacaaaatttgttgtgtcttaataatagtgtaggtataagtaattaaatgaaaaggacagtattttcacttttttattttttgattttttttgagtggcattttagtctagatagtctaagataatgaagacaataacttccttcagtaaatcttatattcttttgtcaaatttttaggaaaaggattactcatttgcatacgtctactctcctctcccacacattacaaagggtataaatacaaattactactttttatgttctaatgcctgggtggcaaagtgagtcattctagccaatgactttaaagtgaaagtgagccaaggttctttctgaacaggtttattcttttctgagtgtcaatttttagttgtttttcaaaagaatatgtaaaatatcagtacctaaataaattttttaaagtagttcctaggatttttattttcacagagttaaacagttaactcagtggacagtgtatcccccgcatattatgaagcagaagcatacttgagtgtcagtgaaatcagaacccaaacaatgtccagtggcacttaccatatttagagctcttaaactatttaataagtaactacgtctgttgtggaactgatatgtagtagtagcctgagtgacatggagaaagctaacattcctttttttgaaagtgtttttttaatttttaaatttttattttagtccctgctgcccatttctctaccaccactcttaatgtttacaaatggcaaagctccagcgtggacaacatagtaagaccccatctctacaaaaaaaaaaaattttttttaattagctgggcatggtggcacacacctgtggtcacagctactcaggaggctgaggtgggaatatcgtttgagcctgagaggttgaggctgcagtgagctgtgattggaccactgcattccagcctgggtgacagaatgagtgcctgtctccaaaaaaaaaataaataaagaaataaaaaggcaaagtaaatgttcaacttgtgtgactatttatatgtacattttgtaatattcagtctacctaaaaacaatcatgttctgaaattctcatgatttggtatttaattgttggtgttcactcatatcacctctttatttttattttttattttttttgccgtggagtttcactcttgtcgcccaagctggagtgcaatggcatgatctcggctcactgcaacctccgcctcctgggttcaagtgagtctcctacctcagcttcctgagtagctgggattacaggcatgcaccaccacgcccagcttatttttgtatttttagtagagatggggtttcaccatgttggccaggatggtctctatctcttgacctcgtgatctgcctgccttggcctcctaaagtgctgagattccaggcgtgagccactgcacccggcctcacttctttaattaaagtggaaaactgtagcatatgctgaaatatatttgtactatggaagtgttagaatatgatttccattgcttctgaattagacctattcgaggtcctaaacatcttttttacagcatttcctttcttaaccaactccacttaactggcttgccagaagaatagtgctctttttcttctgtaaaacatactatcgcccatagcgtgttgaatagtttggctaatctcctagcggctagtctccccaggcttcctgctttctctcagagagttgtatgcattccaagagtcagtagtgaatgttcccaaatcataaatgccagttgaacctatgttataattattcatttaattatgatataattatgaagaaatttaagtgtgaaagagttattctatactatagttgataaaagcaagtcattttcttagttgctactgaacggatataggtgagtcagtggaaaagtaatagtaatataatttaaaaaggattctatacacaaatttctttcaaagtgcctttacagcttgcttcattttggagaaacttaaattaaaacccttctatcattaactgccttttttaaaaaaattaaattaccaagaacaagtacttctgattgcatcagataagaaggctatagttttgaaaactgttattggctatattgggtacgtttatgaagaagctatagtaaatataatatcaaaagcttcacagcttggcatcttctgcaggactttatttagcagcagaaagcccctctgctatcatctatcagtctctccatgttccatagcctaaagatacatatttgtcccctaatctatgatgatggaatggtatgatagactatttaagaatatgttactgttttattttaaactgaaatgtatatttttctgcattctacagtcaccttaaccagaaaacccagtttgaaaatccagtggaggaagccaaaaggaaaaagcagttaggacaggttgaaattgggtcttcaaaaccaggtaagcattcttttcaatcttttcttctaagaataacttgtgaaatttgtatgctgagttaataaaagtgagtttgaacttcttatttctatggctttgacactaaagagtgtctagttgttactgtaaagatatgaataatcttaataaaacatctgaacattatcagaatactgagatttttctcaggagtatacaaaaagcatgaagttgttgggagaagggatttcggcagcttttttatgaatttgagattttgttttgaagattggaatgtttccttatgtttaaggctagaccaatattaggtctccagttcatcgttagcttttcccaagttaattgcttaagtatggtatctgtaaccactgaggattcttcattaaccaatattaataaatactaaatatatcaaatgatttacctacatcattgagtctcaaatgggatggtagctattagtaacatcagattcatttagggagcatttttttaaaaatatagatccagaaatttcgatgagtctaatcatgtgtattttgaaaacactgctcaggaagttcttacattctacttatccctccccatcccttttccagccctcatttgtcattaataaccaggggtatatatggccatattgtagtaatccagtagattctccacttcggttgcctatgagagaaatagttctttcttatagttactcttcaaaaacatcgtcctcctcctaaagttctgcatttcgtttagcaaacattttgagtttaacaaatacttttgagcactgactatatccccagtgctttgctaggctctaggtattcaaaaatgactaagagtaagacagggcttgccctcaagagttcatagtctaatacaggaaactgatggttataatacatggagataggtgccatcatagagtagtagttataatggtaagctgaggagcaggtttgaatcccagctgtgtaatcttgggtacgtttcctaaatctctaaatgctcctatttcttcatatataaagtaggaataataatggtacccaccttttaaggtggttatgagtatgtaaattaacagatgtaaagtgcctacaatggtattaagcacatgttgactaataaatgatagtttcattgttattaatagacatgtacaagttacagtggtggcataaagacgggagtacccaactctgctttggtgggaaatgtcaagtgggcaggagaaatttcaaagcagaagagatagaaactaggtcttgaaaagtcaggaaaagttaaagcaggcagacaaaaattttaaaggagcaagaaagcataccaagtagaaggaacagaatgtttaaaatcacagaagcatgaaatggtgtgccgaaaggccagaaggcaagtaggtgtggttacagcatagggtatttgtagggtagtaacaagcgatgaggttgtagggataggcagccatgagaagaggttgagtatgtcatatgttgctggaatgtcaaggaagttgaagattgaaaaatatgtgttggatttgacagtagggaggtcattagtcactctaggaagagcaagtagagagtgaagtaaaattgcaatagaatgaagagggtatgggaggtcagacagtacaactgttggcaaaatgataaacataattaccatatatttatagtaactgctggaattccactcagtgtatacccaagatgaatgaaaatatgtccacacaaaaccttgtgagtgttcatatcaacattattcataatagccaaaaagtggaaataacccaaatgtccatcaactaatgaatggatcaacaaaatgtgttgtttatccatacagtgccatattatttggcaataatataataaatatattttatctttagtaagtacatatttaatttaatatttattatatattaataataaagagcaataaagtactgacatatgctacaatacagatgaccctcaaaaacactgtcaagtgaaagaaaccattcaaaaaaccacatattgtctgattttgtttatatgaaatgcctatattgggcacatctatacatggatagtagattcgtggtttcctaaggctaggatatggatgtgggttggggagaaattggataatgactgctaatgggcatggggatttcctctgaggagggaagaaaatgttctaaaattagattatgctgatagtcgcatgacattgaattgtacacttgaaagggctaaattctatggtatgtgaattatatctcaataaatttgttaaaaaatagataatggcagaacatttaaaatcttttttacagttaatttaatacttcataaattataaacctgcacaatttgattctctcagtttttgtcactttcctaatggcaggcatggttgaggagaagagagaagaggttctggaaggaagttgttatttgcagatgtgaatcactagggtcatctaacccctaataatgggcatttcaaaagaactatgtatttttttttcctaaattatccactaaacatgagtgaaagggatagaaatatgaagctatttactgatagtaaaaagattcactccttccatcagttataaatcaaagactgcagaaagcctgagctgtgaattataaaaattctcaatatactctctttcataagtttgtgacacttgacttcatcttcctggtatagtactttgcacataaaactcagtagatgctgagttttatagtacagttgaatagtatccaaactttcagaaattgagtgctaaaggttgtatcattttgacttcatataatggactctgggttgaaagtaagcacagacaaggcaatgagaaagagattaagttgagaataacattaaaaagtcatataaaagattgactctgagtgctatattcattgtaattatttttgttctcaaacccacttctcattttggcacagatatggaaaaatcacacttcacaagagatccatcccagcttaaaggtgtccttgttcgagcatcactgaaaaaaagcacaatgggatttggttttactattattggtggagatagacctgatgagttcctacaagtgaaaaatgtgctgaaagatggtcccgcagctcaggatgggaaaattgcaccaggtaagaaatttttcataattatttgaagagtagtgatactataacaaaaattatagtgaagagattttatatacataaagagagagaaataattaaattatataactaaagaaagagattccagtattaaaatagtttatactttaatttaaaaaaaagttgtatgggtatacagtaggtatatatatttatgggatacatgagatattatactatgatacaggcatgcaataagtaataaccacatcatagaaaatgtggtatacatctcctcaagcatttatctgttgtgttataaacaacccgtttatactcttttagttataaaatatacaattaaattattgctgactgtagtcaccctattgtgttatcaaaaactaggtcttattcattccttctagctatatatatatatacacacacatatatataatacacatatatatacacacacatacacacacacacacacacacacacacacacacacatatatatatttttttttgagacggagtcttgctctgtcgcccaggctggagtgcagtggcgcgatctcggctcactgcaaactccgtctcccgggttcacgccattctcctgcctcagcctcccgagtagctgggactacaggcgcccgccaccacgcctggctaattttttgtatttttagtagagacgaggtttcaccatgttagccaggatggtctggatctcctgacctcgtgatccgcctgccttggcctcccaaagtgctgagattacagacgtgagccacaccgcacccggcctttctagctatatattttttatattccttaaccatctccacttccctctcaccgccccaccaaccctaactacccttcccagcctctggtaatcatccttctactctctagctccattagttcagttgttttaatttttagcatccacaaagaaatgagagcattcaaagtttgtgtttctttgcctgacttatttcacttaacataatgatcttcagttccatctgtgtcattgcaaatgacaagatctcattctttttatggctgaatagtactccattgtgtatatgtaccatgttttctttatctaattatctgtcgatggacatttaggtggcttctaaatcttggctattgtgaaaagtgctgtaacaaacatgggagtgcagatatctcttcaatatactgatttcctttcttgtgggtatatactcagcagtgggattgctagatcgtatggtatctctatttttagtgttttgagaatcctccaaattgttttccatagtggttgtgcaaatttacattcccagcaacagtgtatgagggttcccttttcaccacaccctctccagcatttgttattgcctgtcttttggataaaagccatttttaaccagggcaagaagatacctcattgtgcttttgatttgtatttatctgatgatcaatgacctgagcacttattcatattgctgtttctatgtcttctatgtcttcttcatgagaaatgtctattccaatgttttgcccattttttaatcagattattagatttttcctatagagttgtttgagctccttatatattctggttattaatctcttgtgagatggatagtttgcaaagattttctcccattctgtgggctgtctcttcacttgactgattgtttcctttgctatgcagaagctttttaacttaatgtgatcccatttgtccatttttgctttagttgcctaggcttgtggagtatcactgaagaaatttttgcccagaccaatgtcctggagagtttccccaatgttttctttttttagttttacagtttgaagtcttagatttaagtctttaattcaccttgatttgatttttgtatacagcgagagatagaagtcaagtttcattcttctacatgtggatatccaattttcctagaaccattgaagagactatcttctccaatgtatgttcttggcacctttcttgaaaatgagttcattgtaggtgtatggatttttctattctgttccactggtctatgtgtctgtttttatgccaataccatcttcctttagttactatagctctgtagtataatttgaagtcaggtaatgtgattcctccagttgtgttctttttcctcaggctagctttggctattctgggtcttttgtggttccatataaatttcagaattgttttttctatttctgtgaagaatgtcattggtattttgatagagatttgatagagattgcattgaatctatagattggtttgggtagtattgaaaagaatattgattcttccaactatgaacatgaaatatcttttcattttttgtgtcctcttcagtttcttgcatcagcattttataatttttaatgcagagatctttcgcttctttggttaagttaattcctaggtatttaatcttatttgtggctattgtgaataggattacttttttatttctttttcagattgttcactggcatatagaaaggctactgatttttgtatgtcgcttttgtatcctgcaactttactgaatttatcagttctaatagtttttttatttgtggagttgttaagtttttccaaatataagatcccatcatctgcaaacaaggataatttgacttctccctttccaatttgtatgcctgttatttctttctcctgctgattgctttagctagaacttccagtcctgtgttgagtaacagtggtgaaagtgggcatcttcattttccagatctcagaggaaggactttcagtttttccctcattcagtgtgatactagctgtggctctgttgtatatatggcttttattatattgaggtatgtttcttatataaccagtttttttagggttttatcataaaggggtgttgaattttattaaattttttcagcatcagttgaaattattatagtttttttgtttttgttttgttttgttttgttttttagactgagtctctgtcacccaggctggagggcagtggcatgatctcagctcactgcaacccccacctcctgggttcaagtgattctcctgcttcagcctccagagtagctgggattacaggcactcaccagcacgcctggctaattttatatttttagtagagatggggtttcaccatgttagctaggctggtctcgaattcttgacctcaggtgatccatctgcttcaaatgattatagtttttatccttcattctgttgataccatgtatcacactgattatttgcatatattgtaccatccttgcattcctgggataaatcccacttggtcatgatgaatgttctttttaatgtattgtcaaattttacttgctaatattttgttgaggagttttacatcagtacttatcagaaatactggcctgtagttttcttttttttgatatgtctttgatttggatatcagggtaatactggcatcacagaatgagtttggaattattcttccctctatttttcagaatagtttgagtaggaattgtattactcctttaaatgcttggtagaattcagcagtaaagccatcagatcctgggctttactttactgggagactattatggcttcaatcttgttgcttgtcattggtctgttcaggttttagatttctttgtggtttgatcttggtaagttgtgtgtgtctaggaatttatccatttcttctaggttttccaatttgttggcatatagttgctcataatagtctctaacaatcctttgaatttctgcagtatcagttgtaatgtctcctgtttcatctctgattttatttacttggatcttacctctttttttctgttagtctaaggtttgttaattgtatcttttcaaaaaaccaactttttgtttctttgatcttttgtgttgttttcttcatttcaaattcatttatttctactctttctgcttttcttctattaatctagagcttagttttctcttttctagttcttcaagatgcatcatgaggttatttatttgaagtttttctttttttatatatataggcacttatagctataaatttccctcttagtactgcttttgctgtatcccataggttttggtgtgttttgtttccattattatttgtttcaagaaatttttccaatttccttcttaattcctttattgactcactggtcattcaggaacctattgtttaatttccatgggtttgtatagtttccaaaattccccttgttattaatttctgattttattccatagcagttgagaagatacttgatataattttaattttttggaatgttttaagacttgttctgtaacctaacatatggtctatccttgaatgatgccgtgctgaggagaatatatattctgcagccattggatgaaatgttctgtaaatatctattaggtccatgtagtctatagtgcagattaggtctgatgtttccttgttgattttctgtctggaagatctaatgctgaaagtgggatgttgaagtctcctgctattattgtattgaggtctatttctctctccttagctctaataatatatatcatatattatataataattatatatataaaatatataattgtaatatatgataaaatacctctctctttagctctagtaaagcaagtaacacttgctttatgtgtctgggtactccagtgttggatgcatatacatttacaattgttatatcctcttgctgaattgacccctttattattatataatgacctttttgtctcttcttgcagtttttgtcttataatctattttgtctgatataaatgtagctactgctactgttttttggttttcactggcatggaatgtctttttccagtcctttatttccattctatgtgtacctttacaggtgacatatgtttcttctaggcaatagatcatcaggtcttgctttttttattcactcatcttctctatgtcttttgattggagagtttagtccatatggattgagtgttattaatgatcagtaaggacttactcctgccattttgttatttgttttctggttgttttgtgattgtctcttccttatttccttccttccttttagtgaaggtgattttatctgtggtatgatttaatttcttgctttttattttcttgtgtatccattgtatttttttatttgagtttaccaggacgctagaaaatactatattataactcataattataaactgaggacaaattaacactgattgtataaacaaagaagcaaacaagcaaaaagaaaatgaataaaaactgtacaatttaacttcatcccttccttttaaattttttgttatttctctttatgtcttattgtactttgtcttgaagatttgttctagttattattttgattggttcattgtttagtctttctacctaagagtatgttacccaccacaattacagtttaatattctatgtttttctgtgtgctattaccagtgagttttgtaccttcagatgatttcttattgctcgttaatgtccttttctttcgcattgaagaaccccctttagcatttcttgtaggagagatctagtgttcacgaaatcccttagcttttgttgtctggaaggtctttatttctccttcatgcttacaggatatttttgccagatacactattatagagtaaaaggtttttttcctaagcactttaaatatgtcatgccactctctcctgccctgtaaggtttccactggaaagtctgctgttagacatattggagctcctttgtatgttacttgtttcttttctcttgctgctcttaggatcctttctttatctttgacctttgggagtttgatttttaaatgccatgaggtagtctcctttgggttaaatctgcttggtgctctataaccttcatgtgcttgaatattggtatctttctctaggtttgggaagttctctgatattatccctttgaataaactttttacctcattttttctgtacctcctcttttgggccaataactcttagaattgcccttttgaggctgttttctagatactgtaggtgtgctttattgttctttattcttgtttttttttgtctcctctgactgtgtattttcaaataggctgtcttcaagctcactaattatttcttctacttgatcgattctgctgttaagagactctgatgcattgtttagcatgtcagttgtatttttcaactctagatttctgtttgattctttttaattatttcagtctctgttaaatttatgtgacaggattctgcatttcttctctctgttatcttgattttttgttgttgttttctcaaaacaactatttttaattttctatctgaaaggtcacatatctctgtttctccaggattggtccctagtgccttatttagttcatttggtgaggtcatgttttcctggatggtcttgatccttatagatgtttgttggtgtctgggcattgaagagttaggcatttattgtagtttttgcaggctgggtttctttgtgcccatccttgggaaggctttccaggtattcgaagggacctaggtcctaaacccaataacaataagtaccaccttggtattcttggatacgattcagaagaattatctggattaataggcagagactcttgttcttttcccttacattcttccaaacaaacaaagtcagtctccctctctctctctctctctctctctctctctctccctccctccctccctccctccctcactctctgtctctctctttctctctctctgtgctgagcctcttggaactgggggttgggggacataaacatccctgtggccaccaccactgggactgcgctgggtgagacatgaaaccagcacagcactggatcttgcccacagccagctgtaaccactacctggctgccacttaaattaactcaaggccctggagccctatgatcagcaggtggcaaagtgagctaggttcgtgtccctctcttcaggatggtgagtttccccaagccgcgagtggattcagagatatcgtctgggagctagggattgaagtcaaaaaccttagaaatttacctggtattctattctattctggctaagctggcattcaaaccacaagacagacagaattcttcccattcttcaccttccacagacagagaaacctctccctgtggccaccaacactggcccatgtgggtgtgtgggggtgttgccaggccactgctaatgctcacctaaagcacaaaggctcttcagtcagcttgtgatgaatgctgtcaggcctgggactcacccttcaggacagtgggctctcctctgatccagactaggtccagaaatgctgaccaagagcctaggcctggactcagggaccccgagagcctgcgtggtgctctaccctactgtggctgagctggtacctaagctgcacgacacagtcacctttacctttccccctacttttctcaagcagcagtctttcaccatagttaccacagcagggaatgtgctgggtcacgcctaaagccagcatgtctcagagcccagtatccgtggtgtatttattacctgggtattgctattggttattcagggcccaggggctcttgagcaggcaggtgatgaaacctgccaggtctctgctgtgacagggcagcactgagttcaatgaaaagtccatcagccactgtgctccccctctcacaatcacacagatttctccataccaggtggctgctaccgggagctaagggagaggtggcgtaagcactcccttagctgccctggctggtgtctcgtaggttgcagtcaggtgtctctgatcccagctcagcactaggacttgtctaggaattgcagtccttgtggcctagactgccactcatttcactcggggcccagagcactccagcccccagtggtgaggcttgctggaactcagtctccaatcactggaatgggcaattcccctatggctagggtcgacccaaatgctccctttgttggcatatgtcagctgagtacagcctggttctgctttcccttgtgacaggggagcactgagttcaatgcaaatcctgacaatcgctgtgctcaccctctcccaagcatgcaaattctcaccaccagtgcagggaggatgggggagtggtagcactggcaattccagactgcctttcctatcttcttcagtgtctctttcagtgatatgaagtccaaaccaggcactatgattgctcacctgctttttgtctcttgtaacggtacttttagtgtgtagttagttgttaaaatttggtgtttctgtgggggtagggggatgagtagtgtaggcttctatcccgccactttgctctgccctccgtcaccatctatcctctaaactaaatgcatattatctttgatggtgggccattttacaaacaggtgaaaactgttggagaaaacattaaatttattaatattttgaaatattttatataactttgagataatccttttgctgtataaaactaaagatttattaatcatctcagaaaaatatttgtttgattttcttgaattataaaggatacttttggagcaaacatttacctataaccttatttgaaaaaaaggtcctgtgtggtgtttatcatggtatcaaattattaaatcttgccgtttttcccaagtttgtttgcttccttaatcttactggttattaaattgaactcctatgttaagaattgtagacataacattaccatttttacaaagtagtgtaaacttgtcttttctatagtttcctaaagcctttacttggtaattgctggatattttaatatggctgggagtgtttgtggttcaggaacttggagaaggttgaagactagtttctgattgcggggggaagtttaagtattgttttccagaaagattttagtattaatactgaggttgctttttgcagtgtttgctagacttttctaatcctctgttatttcacataccgtgaaaatatggaccaacattcagatggttgaattgtcatagtattttttgatctctcatattatgctttcccattgaggtaacaaaaacttaaaacaggaaaacttaaaataatcaagttatacttgtaaagaaaattatttttttctactttattactttataaagttaacaaactttagagattaaaattaatagtaaggttcttttgttttcagttttgaccttttcaacattttatccatgaaacacatgtcttagctattgtgtatgctgtcaggatttcaaaatgtagtttcatatttgcctaatatgcttatctaatttgcatggcaatacaatatttccgtgaaaattctgggagctttaataccagattgagttttttaaaagccatcagaacaaattaaagcacctttgtttggcaataaccttttaaataatcatattcaaataaaagctaattgatgagacaacaggggccaaattttaagtcaagactgtattaaaaaatacccaactgatgaccgtcaactggtaatgattctacaaccaaaatagtcttactaatgtcaaatcaggaaagcaaaaccaacttttagagggatttattaagctgccttgtcagtgtcttcaataatgcattgtttgcttctgttgaattttttgttgcttgtttcaccttttgaaatctgatttatacatcaaattcaaaattgctggaaaaagaaggatactacaagaaaatacactcataaattaacatcattctaatcttcagttcaaaatttgtcaaactagaatgaatttttaaagtacattgttagcaatggcttttgttttgtttagttttttagttttttttttattattattatactttaagttttagagtacatgtacacaatgtgcaggttagttacatatgtatacatgtgacatgctggtgtgctgcacccattaactcgtcatttagcattaggtatatctcctaatgctatccctcccccctccccccaccccacagcagtccccagagtgtgatgttccccttcctgtgtccatgtgttctcattcttcacttcccacctatgagtgagaatatgcagtgtttggttttttgttcttgtgatattttactgagcatgatgatttccaatttcatccatgtccctacaaaggacatgaactcatcatttttttttttttttttttttttttttttttttttttttttgagacggagtctcgctctgtcgcccaggctggagtgcagtggcgggatctagggttactgcaagctccgcctcccgggttcacgccattctcctgcctcagcctcccaagtagctgggactacaggcgcctgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccagccgaactcatcattttttatggctgcatagtattccacggtgtatatgtgccacattttcttaatccagtctatcattgttggacatttgggttggttccaagtctttgctattgtgaatagtgccacaataaacatacttgtgcatgtgtctttatagcagcatgatctatagtcctttgggtatatacccagtaatgggatggctgggtcaaatggtatttctagttctagatccctgaggaatcaccacactgacttccacaagggttgaactagtttacagtcccaccaatggtgtaaaagtggtcctatttctccacatcctctccagcacctgttgtttcctgactttttaatgatcaccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttgtcttgtaaatttgtttgagttcattgtagattctggatattagcccttcgtcagatgagtagattgcaaaaattttctcccattttgtaggctgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctaatccatcttgaattaatttttgtataaggtgtaaggaagggatccagtttcagctttctacatatggctagccagttttcccagcaccatttattacatagggaatcctttccccattgcttgtttttctcaggtttgtcgaagatcagatagttgtagatgtgcggcgttatttctgagggctctgttctgttccattgatctatatctctgttttggtaccagtaccatgctgttttggttactgtagccttgtagtaggttgaagtcaggtagtgtaatgcctccagctttgttcttttggcttaggattgacttggcaatgtgggcttttttttggttccatatgaactttaaagtagttttttccaattctgtgaagaaagtcattggtagcttgatggggatggcattgaatctataaattaccttggtcaatatggccattttcacgatattgattcttcctacccatgagcatggaatgttcttccatttctttgtatcctcttttatttcattgagcagtggtttgtagttctccttgaagaggtccttcacgtcccttgtaagttggattcctaggtattttattctctttgaagcaattgtgaatgggagttcactcatgatttggctctctgtttgtctgttattggtgtataagaatgcttgtgatttttatacattgattttgtatcctgagacttttggcttatcagcttaaggagattttgggctgagacaatggggttttctagatatacaatcatgtcatctgcaaacagggacaatttgagttcctcttttcctaattgaataccctttatttccttctcctgcctaactgccctggccagaacttccaacactatgttgaataggagtggtgagagagggcatccctgtcttggcgagttttcaaagggaatgcttccagtttttgcccattcagtatgatattggctgtgggtttgtcatagatagctcttattattttgagatacgtcccatcaatacctaatttattgagagtttttagcatgaagcgttgttgaattttgtcaaaggccttttctgcatctattgagataaccatgtggtttttgtctttggttctgtttatatgctggattacatttactgatttgcgtatattgaaccagtcttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccagctttggtgtcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagagcctgttattcgtctattcagagattcaacttcttcctggtttagtcttgggagggtgtatgtgtcgaggaatgtatccatttcttctagattttctagtttatttgcgtagaggtgtttgtagtattctctgatggtagtttgtatttctgtgggatcggtggtgatatccccttttatcattttttattgcatctatttgattcttctctcttttcttctttattagtcttgctagtggtcgatcaattttgttgatcctttcaaaaaaccagctcctggattcattaattttttgaagggttttttgtgtctctatttccttcagttctgttctgattttagttatttcttgccttctgctagcttttgaatgtgtttgctcttgcttttctagttcttttaattgtgatgttagggtgtcaattttggatctttcctgctttcttttgtgggcatttcatgctataaatttccctctacacactgctttgaatgtgtcccagagattctggtatgttgtgtctttcttcttgttggtttcaaagaacatctttatttctgtcttcatttcgttatgtacccagtagtcattcaggagcacgttgttcagtttccatgtagttgagcggttttgagtgagtttcttaatcctgagttctagtttgattgcactgtggtctgagagacagtttgttataatttctgttcttttacatttgctgaggagagctttacttccaactatgtggtcaattttggaataggtgtggtgtggtgctggaaaaaatgtatattctgttgatttggggtggagagttctgtagatgtctattaggtctgcttggtgcagagctgagttcaattcctggatatccttgttgactttctgtctcgttgatctgtctaatgttgacagtggggtgttaaagtctcccattattattgtgtgggagtctaaatctctttgtaggtcactcaggacttgctttatgaatctgggtgctcctgtattgggtgcatatatatttaggatagtttgctcttcttgttgaattgatccctttaccattatgtaatggccttctttgtctcttttgatctttgttggtttaaagtctgttttatcagagactaggattgcaacccttgtcttttttttgttttccatttacttggtagatcttcctccatccttttattttgagtctatgtgtgtctctgcacgtgagatgggtttcctgaatacagcacactgatgggtcttgactctttatccaatttgccagtctgtgtcttttaattggagcatttagtccatttacatttaaagttgatattattatgtgtgaatttgatcctgtcattatgatgttcgctggttattttgctcgttagttgatgcagtttcttcctagcctcgatggtctttacaatttggcatgattttgcagtggctggtaccagttgttcctttccatgtttagtgcttccttcaggagctcttttagggcaggcctggttgtgacaaaatctctcagcatttgcttgtctgtaaaggattttatttctccttcacttatgaagtttagtttggctggatatgaagttctgggttgataattcttttctttaagaatgttgaatatcggcccccactctcttctggcttgtagagtttctgccaagagatccactgttagtctgatgggcttccctttgtgggtaacccgacctttctctctggctgcccttaacattttttccttcatttcaactttggtgaatctgacagttatgtgtcttggagttgctcttctcgaggagtatctttgtggcattctctgtatttcctgaatttgaatgttggcctgccttgctaggttggggaagttctgctggataatatcctgcggagtgttttccaacttggttccattctccccatcactttcaggtacaccaatcagatgtagatttggtcttttcacatagtcccatatttcttggaggctttgttcatttctttttattcttttttctctaaacttcccttctcgcttcatttcattcatttcatcttccatcactgataccctttctttcagttgatcgcatcggctcctgaggcttctgcattcctcacgtagttctcgagccttggctttcagctccatcagctcctttaagcacttctctgtattggttattctagttatacattcgtctaaatttttttcaaagtttttaacttctttgcctttgatttgaatttcttcctgtagctcggagtagtttgatcgtctgaagccttcttctctcaactcgtcaaagtcattctccatccagctttgttccgttgctggtgaggaactgcgttcctttggaagaggagaggcgctctgctttttagagtttccagtttttctgctctgttctttccccctctttgtggttttatcttcttttgttctttgatgatggtgatgtacagatgggtttttggtgtggatgtcctttctgtttgttagttttccttctaacagacaggaccctcagctgcaagtctgttggagtttgctagaggtccactccctaccctgtttgcccgggtaccagcagcggtagctgcacagcagcggattttcgtgaaccgtgaatgctgctgtctgatcgttcctctggaagttttttctcagaggagtacccggtcatgtgaggtgtcagtctgcccctactggggggtgcctcccagttaggctgctcaggggtcaggggtcagggacccacttgaggaggcagtctgcctgttctcagatctccagctgcgtgctaggagaaccactgctctcctcaaagctgtcagacagggacatttaagtctgcagaggttactgctgtctttttgtttgtctgtgccccgcccccagaggtggagcctacagaggcaggcaggcctccttgagctgtggtgggctccacccagttcgagcttcccggctgctttgtttacctaagcaagcctgggcaatggcgggcgcccctcccccagcctcactgccgccttgcagtttgatctcagactgctgtgctagcaatcagtgagactccgtgggcgtaggaccctccgagccaggtgcggcatataatctcctggtgcgccgttttttaagcccatcagaaaagcgcagtattcgggtgggagtgacccaattttccaggtgccgtctgtcacccctttctttgactaggaaagggaactccctgaccccttgcacttcccgagtgaggcaatgcctcgccctgcttcagctcgcacacggtgcgctgcacccactatcctgcacccactgtctggcactccctagtgagatgaacccggtacctcagatggaaatgcagaaatcacccatcttctgcgtcgctcacgctgggaactgtagaccggagctgttcctattcggccatctcggctcccacctgtttagtttttttgtttgtttgttcgtttgtttgagaccaaatctcactcttgtcatccaggctggagtgcgatggcagaatctcggctcattgcaacctccgcctcctgcgttcaagtgattctcctgcctcagcttcctaagtacctgggattacaggcgcacgccaccatgcctggctaattttttttctttttttgagatggagttttactcttgttgcccaggctggagtgcagtgctgcgacctcggcttactgcaacctctgcctcctgggttcaagcaattctcctgcctcagcctcctgagtagctgggattatagcacataccaccacacccagctaattttttgtatttttagtggagacagggtttcatcatgttggccaggctggtcttgaactcctgacctcaggtgatccacctgcctcagcctcccaaagtgcggggattacaggcgtgagccaccgcgtctggcctaatttttttgtattttagtagagatggggtttcgccatgttagccaggctggtgtcgaattcctgacctcaggtgtactgggattacaggcatgagccgctgcgcctggcctgagccaccacgcccagccagtggcttcttaaactcaagaaataaggtggtatttaaagatagactgaccctgtcaaaaagtggacaaaggatatgaacagatacttctcaaaaaaagacaattatgtggctaacaagcatatgaaaaaaagctcaacatcgctgattattaaagaaatgcaaatcaaaatgacagtgagatatcatcttacgccagtcagaatggtgattattaaaaaatcaagaaacaatagatgctggcaaggctgtggagaaacaggaacgcttttacactattggtgggagtataaattagttcaattaatgtggaagacagtgtagcaattccttaaggatcttgaaccagaaataccatttgatccagcaatcccattactggatatatacccaaaggaatataaatcattctactataaagacacatgcacacgtatgtttattgcagcactatttacaatagcaaagacaggaaccaacccaaatgcccatcaatgatagattgcataaggaaaatgtggtatatatacactatggaatactatgcagccataaaaaggaatgagatcatgtcctttgcagggacatagatgaagctggaagccatcatcctcagtaaactaacacagaaacggaaaaccaaacgctgcatgttcttataagtgggagttgaacaatgagaacacatggacacagggccgtgaacaacaaacaccagggccagtcgggggttgggggacgaggagagggagagcattaggacaaataactaatgcatgtggggcttaaaacctagatgacgggttgataggtgtagcaaaccaccatggcacacttatacctatgtaacaaatctacatattctgcacttgcatcctggaacttaaagtaaaatttaaatatatatatatttatatatgatatattttatatatcatatatataaatatatataatattaaatatatatatgatatataatatatatacactatatatgatatatataatatatatgatatataatatatatgatatatataatatatatgatatattatatatgatatatataatatatatgagatatatattatatatatgatatataaatatatatgagatatatattatatatatgatatataaatatatatgagatatatataaatctatatatatatcaggggtggaggaggatttctggctataggggctataggaacttgacaggattcttgctgaatgcaggctgaggtgatcaggtaatcacctggagaatggtggggaatgaggacttagatcatatatcaagagtgggtgattctggctaaaccaacttagcaggattcctgctaaagctgggctctggaggacatgccaaggatgaggcctactgaaaaaagagctcagaggaacctgtctagagtttggttaaggacagcgtctttttcagtgtatgtatatatacatacatacagatatataaataaaattaatttattcaaaaaatataatacagtttgtacaagtagtcagtggagttatttgcttctgtactaaatacctactgcaatgtgcctagctttgcatggatacttagatatgactcagagggtatactaacaatgataatataaattatcagggttttttttttaatgattcacttgagcttgaagtcaaaattctttgctactgaaataagtaggattttagacatttatacatacattttagagaggagttagaaaagggagaaggtctgtgttagaaatctatcttttcagcagttaatagaggtttccaaaattcaaatttagttgctaaattgtagttatttttgcccctctagcaaaaaaattaacttatttgttgattttaatatttttaacatgattatgtttttccaggcgatgttattgtagacatcaatggcaactgtgtcctcggtcacactcatgcagatgttgtccagatgtttcaattggtacctgtcaatcagtatgtaaacctcactttatgtcgtggttatccacttcctgatgacagtgaagatcctgttgtggacattgttgctgctacccctgtcatcaatggacagtcattaaccaagggagagacttgcatgaatcctcaggattttaagccaggagcaatggttctggagcagaatggaaaatcgggacacactttgactggtgatggtctcaatggaccatcagatgcaagtgagcagagagtatccatggcatcgtcaggcagctcccagcctgaactagtgactatccctttgattaagggccctaaagggtttgggtttgcaattgctgacagccctactggacagaaggtgaaaatgatactggatagtcagtggtgtcaaggccttcagaaaggagatataattaaggaaatataccatcaaaatgtgcagaatttaacacatctccaagtggtagaggtgctaaagcagtttccagtaggtgctgatgtaccattgcttatcttaagaggaggtaagtaaaagcacaacatagaaaaagtttcagtgttcaagcgtttatatctactgattgtctttccttacagtttagaatgtgttttcccagcagacttaactagtaattagtgtgcattttccttaaggttctgtctgattgtttccataagcagtgtctttttcagcagtttttaaaaaattattagtgatttcattcatgtccattatggatttatttccctctgtattcttttgaaaatctgattcatggctttaatgattagagagagtcacagcattgtgatacttcaaatgaaatacatcctcttaatttcatttctctgttgatgacagtaatagaaattgactctttcaaccaatggtgtgtcatctggacctctgtaatgcaccaaagatgttttgaaagagctagcatctctgtggataagtaaaatgttggatggtgtattaatctgttctgcagaggcaatcatgatagcatgtgctcataaagttttcatcttaagctctagtatctgactgtaaatgttaattaaaccacacagtgcttatgtgagagaaatataatttttattttccaaggtcatcagctgacatgaactcctcccagacatttacaaattcagttccaaggaataatcacaaagttgaattttaatatgctttcttaaatccatacttataagtgactagtatcttaaagaataaaagccacttactcttttatctctctggattttacttttcactattgaggcaaacgagcacttcagcttctttgggagttgtttcttattctcgtttctttgattcacatgggtttcttctctgagtgatggtggaatgtgctccaagtaaggtagaaatctctttgtgagtgcttgagagtaatccagggcttcaacaagtataacaaagacaccaaagttcaatgtcacacaggtttgatgtcagtttcctgccttgccacttactggttctttggtataggaaagaatcttagtttaccttctctgtaagatggtcataacatttgtgccttcagattgttataaaaatgaaatgagataatatatgtataatgcctggtacataggaggttagacacagaatttactagcgtactaaaagttgaagctagttttatcgtaaacattagcagtatttgtgatctgggaatgcatcctctggttttaaactttggttcattttttttttaaggtcctccttcaccaaccaaaactgccaaaatggtgagtatacactggtcctcaaatcttttccccaacacactgagagagatgccacattcccctctgtaagaggagctcactgtggtgatgattatcgactgggagaagttaggaggcatgctgcccttggcttgtatttattagaaactagggaagcgtttgaaaaagccccctagtgaggagatgtgctccactggttaagtattgcaactggaggattactaaaggcctattgtaccaataatcctgttctctaagttataaaatgtgaacacattaaagaaccaacctagaggtctttttacttttgtgtttcagagaaacaaggtaggaaggacctaaatgttaagacagatgataaactattacatcgtcttgcccctgcctgaagagaagacgtactagttcacataattttgtggggactataaatatgcatgcacctttagataatcttcttacttttaagactaaattaggcttatttttttattatttattttttatttatttatttattttttgagacggagtcttgctctgtcgcccaggctggagtgcagtggcgctatctcggctcactgcaacctccgcctccggggttcaagcgattctcctgcctcagcctcccaagtagctgggactacaggtgcacgccaccacacccagctaatttttttgtatttttagtagagacagggtttcaccatgttggctaggatggtctcaatctcttgacctcatgatctgcccgcctcggcctcccaaagtgctgggattacaggcatgatacaccacgtccggctgactaaacaagactttctagagtaattgtggccttctatgctaaatttgcttgttgtcaaagtgaaagacctgaaacagtgtcttctttggcattcttctaaataatcacgtagcctgtttaaggacctgtgcagagaataagaactttaaaaaggagtgcatcaaatgctgctgttgtggaagaaactctacaaggtgcacatttgtagctatttaaatatccacaatgttttggatataaagacaattttatttaaaattctaatttagttctagtttgctcctttggagtcttttatctcaaaatcaaaagatggccttccataaccataaactatagacaattatattaaatgaattagttctttctagcccaccaagtaggaatcctctgcaaatttgctgttttatagattaaaaagaatccctcagcttctggccttttttttttttttttttttgagacagagtctcactccatcacccaggctggaatgcagtggtgtgattttggctcactgcagcctctgccgcctaggttcaagcaattcttgtgccttagcctcccagtagctggaattacaggtgcacgccaccacacgcagctaatttttatatttttggtagagatggagtttcactacattggctaggctggtctcaaattcctgacctcaggtgatctgcccacctcggcctcccaaagtgctgggattacaggcatgagccactgcgcccggccagcttctgcccttttcattgactgcttatactacttgggtccagtgtgaacagaaattgtttttgtccattcagttcaaattgcactgtattctacatttctctggttcctctagtaatcatttttaactcctgtgccaccatatttatttcataatggatgccactgcagtcgcagtggccctaatgctttataattgatggaagggtctgatgaactttaaccgcctctgacagaatgctaagatgtatggggaagggtaggagactactgttagcttctctgccttctcattgggtctgggtgattgaagggtcccctctagcacgacactttgtagtggctgacccctgattactccctgacagactggtgcccctgcattctagtcattgttaatgatcacaaacatccataatctccctctcctaacaataatccaggaaaacgagctggtctcaaaaccatatttcttaggccatttattggatttcattgttaacattttattaaataagtcattttgcttggctgttatcttgggaaagttctagctgaataggaaaaatatcaaaatatgctactatgctttcccttatctaattgtcttgcatggtacattttctcttaatatatgtgaattggccagacagggttttcacagtgccatctttataacctaaattagagttaacctctcctgttttcttagaaagagtattatcttaaacatcttccttagaaattaaactcagtgaatgggaggtgggccgtgctaagaattttatgaagatattctctgaatctccctcttactttacttagaagtgctgccttgtattgtatttctatttatcttcatctcaaagtcaatttgtgtcttggtggtggagaaaagggcaaaattgtttaaacataggactaactaaggctcttcagttgatattactataaacttttttctaatttaagttaaatatgtttcaaccaaatacacattgctatgaaaatgaattcctgtaactgtaaatctgctgtgtctttgatcctgccacctatacaactataatcagttgacatatccatttcagatatcagttttatgaattaatcaaccatctgctttttaaaaaatactaagtaaggctcttttccatttcagaaaacagataaaaaggaaaatgcaggaagtttggaggccataaatgagcctattcctcagcctatgccttttccaccgagcattatcaggtcaggatccccaaaattggatccttctgaggtctacctgaaatctaagactttatatgaagataaacgtaagtagttgtggaatatttcaggagagcatataacaagataaatttggatttattttagactaggaccttcccatctttcagaagcatattgaaaagttattccttcattaccattttaatagaactctggacttcttccatgtatattcgacattcacacattcatttttttcaaaatcatgctttaagtgctagttatctaccagatgccatactaggtaaccagaatacagagataaataggttacataggacctgcacccaaaaatattattagaactaaatggaaaaagacaaatatgtaatcaaatagtatacaaataagtacacataataagcctaacaggtacagtgatagaaagatgaaatggataaattgggatccaaagaaggaatattcagttttatcagtgtgggcagtaggaagtgtcaggaaaagcttcatactggaagcaaagctttaactaagtcatcagggatgaaaaagtgtctttgaggaagataaaagggaaagatagaaggaatagcacatgcacactggccttgcatgacttgggctctgcaagtagttcactttcgctgggtgcaattggcaaggaaagtcacagaggagagcaggaacagattgaggaaggccaatgatgcccttccaagggagctggagttggtcatataaataacagagaaccacagaatgcctttaactataaggaaggcatagttttgtgttttagaaaggtttttctggcaggagtatgaaggatgaatcagaggtgtatgcaatttgagggagggtgtgcaatttgaagaagaaactaaagagttgactccttacaggagtccagctgagagataaaaagagagactgcataaggcagaaattcatgcatgttcctactaattcacttactaatgataaatcttttccaaagtaaaattgcagatttgagtaggtataattttttaaaatttatttgttcttagaaagagatgtaaatctaccttggaaaagatatgtacaagtggaatatatgtatagttgacttaatgcttatttaactagttgcagaagtacatcttgataatcccaagccatattcagaaagatgaaaaccagttgtacgcccagcaaagcaataatttaaattagcataacaatgtagaatccctttcttcatactttccattcatagcctgatacattattaatactggtataaactctgcagtcccatcaggcttcacccataaaataagtgagttgaactgatgactctttttttttttttcccctgagacagagtcttgctctgtcacccggagctggagtgcagtggcacaatctcagctcactgaaacctctgcctcctaggttcaagcaattctcctgcctcagcctcctgagtagctggcactacaggcgtatgccaccatgactggctaagttttgcatttttagtagagacggggtttcaccatgttagtcaagctggtctcaaactcctgacctcgtgatccgcccacctcggcctcccaaagtggactcttttaatctctaaagttctacaattttaataggaagtatatatcaaaagatactgcttctatagaatattatcaggaatttactaatctcactttttacatagttccctgacatgtttatttcttctctctttacagtaaatacttcttacctataaataacattaatattttcccaaaggaaaaattttagtcatgaaatagatttttgtgacttaatattctttttttttttttttgagatggagtcttgctctgttgcccaggctggaatgcagtggcacgatctcagttcactgcaacctctgcctcccaggttcaagcaatcctcctgcttaatattctaaggaatacaacctaccctttgagggtaggacagtatgagttaggagattagaccctggaaatcaacctggatttaaatcttagcttcaccacttgctatgtgacaatggccaacttacttacaccctcagttttcccacctagaaaatggggctaataataaatgttagctcttaattattttcctttaaaatgctatcattttgcaaaactaggctaggtaagtagttcatatggaatacttttctgagagaaaggtattagcttgagagcaggaataaggtattttacaggcactctatacagcagtgcctgtacagatttaatgtaccttacccaagtgttaacttaggtcatttgcacctgtcaaatatcaaactcaagtttgatcattctgaattcaacattgttatattgattggacagcattagaagttaatggcagtgtaatactgagtatatggaagtgagagtaaatgtttctaaacagtcttcatacagttttgtttagagctcaaaacgaggatttatagttgaattgtgtgtgtgtgttacactcttgtgcaaattttccatattaaaaagttctgagattatagtttattgagttactctataatatcctactaaatactgaactttgttttgttttaatccttttaaaataaatcatagtatttatattttctgattttcctcagcaccaaacaccaaagatttggatgtttttcttcgaaaacaagagtcagggtttggcttcagggtgctaggaggagatggacctgaccagtctgtaagtgtcacttctttggaacatggctgtttcctgttcaaacgttttgagtggtgatttggtggattatggtgtgttttaagtttttttttctctgacagtttcattaatatgaagaataactgcatttccattattatcatagtccctcagttattgtggtgtagctgaggctaaaaactgtgggtaaaaactgaatatgtcagctgcaaattagacagtgattaatttatttacttctctgtgtgaataactacataaagcttattttaagtttatattttcctttgccctcattaaacagagtctaagacattttccttctctaagaagcctataatcccatgtcctctttcccactattactctatcttctggatgctccataaatggttggcatgagcctgtgcatattgtttcacctcgtcttattaataggttggcattttcatgctcagtactttgcatgtcatttcatctgttacctttgaaactagaggaatataaaataattaatatttttgtccagaggcataagggttatatttgcaaagcatttgaagtctaggattttgtttacacatgattctcacataaacttgttttagagaacaaatgtagtgggttttgtttctaagttttgctcttggtttgaataacaaagaagtaatgtgttctgtagcatttttaagaacatatttgcattttattttatataatatcaatatattatatatcaaaaaatatggttggaagttaggtgaagaacaataatctttaaaaattacaggcttcttatttctgaatagaacatttgatttatgtagtataaatttgttctaattggtcatattggttacagttacaacagtcattggagacacataaagcttaaggcaggttgccctatgtagaacaaatactagatactttaattgttcttggtatttgtatttttgttttattgcttcctattttgttgatactcataatgttcacttagacattttaagaatttgtctcaaacaacttagaagaaacctttcttttctcttaaatgtcagattttagcagctctgaaactagcctaaacattcaggattgcctaattacaggattctaatgctggtgagcaaaatgaaccagatttgttcacctagatgcaagtgaagcttcaggccactctgttcccgctgagatttagaaacaagaaatgtctctgtgctgtgtatattgaacttgtaccgttagtcatatgtgatgggagtactgttgagaatgatcccagttgctgtgaacagtatgtagaaaatcttgcctgatgacattgaacagacttttaatagctactctgcagatttatattttctgagtttagtgttttgtttcattgtaatgatagggataatggttgtgctttttgagttatcgaacaactttgtattttctattttctttgtacacagccctgaggatctataagggattacataatacaatgtggttatttgaagtgccattttggagaatgggcactttctcagataatacctttctaaaatataactgttttcatagttgaactgcaaaaatctgttggtttgcacaatgctaagttaggaattccttaactcttcagctaaactttacactgtggaccaaactgtactttgttatcttatcagatatatattggggctattattcccctgggagcagctgagaaagatggtcggctccgcgcagctgatgaactaatgtgcattgatggaattcctgttaaagggaaatcacacaaacaagtcttggacctcatgacaactgctgctcgaaatggccatgtgttactaactgtcagacggaagatcttctatggaggtgtgtgaacttgttcctgctctgaaaagttaaaaaagaaacaaagatactagtctacttcctgtgtagttttgcaggttattttattacattcagtagtatctaagataacccatttggtgtgatccagggcctcactgtggaaggctatgcaaacacaaaaggattcagaaataatactactataaaaaaataaattttgggcttctatattaagattattttcatatattgatgcattttgcaaatgtattataggtgggagtattgatttaaatccggttttgttttgttttgttgagttgaggtagagtctcactctgtcacccaggctagagtgcagtggtatgagctcagctcactgcaacctccacctcttgggttcaagcgattctcctgcctcagcctcctgagtagctgggattacaggcacacaccaccacacggctaatttttgtatttttagtagagacggggtttcaccacattggccaggctggtctcgaactcttgacctcaagtgatccacctgtctcagactcccaaagtgctggaattacaggcgtgagccactgtgcccagcctaaatttgttttgtttttttttaaataacaaatacaaaattatttagtcataccaagatatcccactagctgaatatacaaagatttttggatcccagtgaaatctgagctactaaaggaaagtaggatgtttctacttgagaagttttagtataatttaacatttattgagtgcttactatgtcctagatgcatggattattttatttaatcttcacaacactatgaggtcattatctagttctatgattactcagagaaaggttgagaaacaaataactggtaagaggtagggcctggattaaaagttgcagtttaattcagagatcagggtttaaaccatagcattaggatatgaatatctcttatagtttctcgccagtagctttatgaataattaaatagaaattcttataagtgaattctttccactttaaaattaaaaaaatacaactctgtagcacaagaatataagcctcatgaaggtatgaatttttatttgtgtagttatctgctgtaagctcggcacctaaaagagtgcctgtctggtacaaagtggacattaataaatgttgttaattggatgaatatttacatcactcttaaaaatgaggcactgtattttttattgcaacattcaaagtaaaggcctgcctcctttggtaaataccaggcatttagaatgcatatagattgtaatgcagtactgcctcaatttggttgtgttggaggccaaatgtaactacttacagtaaaattgtgatgttatacaacctacgctcttccctggaaagaatcatgaagaagtttcatagtagtttggtattattggagacattttagctaatacattctaactatgcattttgaaaaaaaaaaagaaaaaaacatattcttaaaaccatgtgaattttcagccagaaagagaccttataaatatggacatgactgcagtgtgttgtggttattattaacgatggtttgtaccaaattatggcaaaaaatatgccctttttaaaaaatcagttaggactttgtgtcattctcaagttctgatgtcatccttgaagagcagaaaaaggtgtaggttaattggccatttgtcaggaatttcatatgaccctgtctatgcccagaagtgtttgctattcatgtggacagcttgttatgtgtcccagcaagttgaggggtggaggttggggaggttgaaggctgagaactgctaatgatgaactcatcttatatcatcactcaggaaactgcagttgcaaaacacatcatataagacaaatcctgtacaggtagcaaactgttataatggggcagcatttctgccctgatgctttaacctctaagacagacatcaatgaatatcagtcactgagctaaattatatttataattgattttaaaaggaagttcatgtgtcattcctcattatgtgtttcattaaaattattggtccatgttataaaacttgatggaactaaaacagttttaggaagaatttttttactatcaaatctcacagaaactttgaaaagcttcctttaaaatgagatcatgaggtcaggagttcgagaccagcctggccaatatggtgaaaccccatctcttctaaaaatacaaaaattagccgggcatggtggtgggcacctgtaatcccagctactcaggaggctgaggcaggagaatggcgtgaacccaggaagcagaggttgcaatgagccgagatcgcgccactgcactccagcctaggtgacagagcaagacgccatctcggggaaaaaaaaaaatgagataacatgagattgtatgtatttttcagtaatccactctgagtatttgggaagtcggatggactgctgttgcctacatctgcactcagattatacccgaagctcacatgtggggctgcttttctattctttatgttattagaaactgaatttttctgtgagaggcttagcataaaaacactttagtcaccagaaattatgatgttccagacatatcaaaactgatcatgtttattacagaaaaacaacccgaggacgacagctctcaggccttcatttcaacacagaatggatctccccgcctgaaccgggcagaggtcccagccaggcctgcaccccaggagccctatgatgttgtcttgcaacgaaaagaaaatgaaggatttggctttgtcatcctcacctccaaaaacaaaccacctccaggaggtaagggctattgtatcttattgtctctccctgcaagtccagttttctgaggctcccactggagtttatgaaataattaggagctatgtataaaatgccttaggtacttatctttttaagaatggtgaatactttccttattttcaaaattaggtaatttgaaccgaaccttccaggcttcaagtttatctattatctcacattctataaaatatttaataagtctcagtagctccatttgcctcaaggttatactgaagacagtatgtcatagatatggatttaatgaaaggtataatgctgacttttaagaaaatggggacataggttttgaaaattaggataaatcgtgtatgtagaaaatagagactagaagcaattgagaagaagcaaagcagattaacagaaaaatcttgacccaaatatgtcgtagatattttatgttattatttaataataattgccatagtccagctataaattacccttgttgaatgataagaggcataccttttataaatgtttcattgaaaggtaaaaattttgtcaacaattggaaaatggatctaaatatcttgaaccaagtttaacagaatattctaatccagaagatgaatgtatttatatcagttccatgatcaaaggaggaattacatctgatatattcagggctgttacgattcagcaaatgaaatatttgtcttgatatttctataaaataataatttttaatataattataaaatccagttgaatatgagaaccagctccaagtcaaataataaaaatctttgaccacatgaaaatgtgcccttgcctttacaagtcagtttgattatgttttgaatagtgagatccttttagaccaagtggttgctaaaaccttagtttaaaaaaaagaaaacacttttaggaaagtgttgtgagccaaatcagtttgcaaaaatcttgctaaaattaatggaaatgtataagggaaaaagagtccatgacatggatgagttattgctatagtattaggtcactgctcactgatgctagtttccattttcccaaagcagttgccatggaaacacttggaactggaactgtcactgatgctgtgaggatgataatatggcgtgtgtcagaaaaatgaaaggaaagcagcttttaggtggttttcatgttgtatcattggaatcagtatttccaaaaacagataaccatttaggataatgatattgtcattctcgtaacatacaataacaccaggcattcagattaactaaaacagtgaaagtattactctagtagatagatgctaaccactttctatattgaagatattccctttctagcactacagaaatttggggaaagtctagtgttcactataaaactaagctatatagaggaattcagtaaaataagtttcattgcttaaatatatttaagcatatttttacatttatttatatttaacatttatgttatattaaattttaatatattaagtatttttatttgtatatattggtaaatttttaaaaatttaaaaatctttaagtagttttatatttccttgtttcaatcattttttactattgtgatggttttacctatggagatacttcatctctttaagatagtgtcattaagtgttgtgttttgtaatccaacaaacttggattcaagtcctgcttatgtcttttaatagctgtctgatcttgggcaaattactttccctccaagagctccagtttcttccacaaaatgaggatgatagagacactccctgtctcatgaatgtgaggattaaaggagacagggtatgtgaagcccttagccaaggccttcagtaaatgttagctgctgttgcttgttgtaacttctgctgccattgttatcatcatcattatttagaaaattgtcaccgtctcttaacttttcttttaaaaaaaaacttttaaaagttcatcaatacttaataatgagataggaaagaaagcccaattaaaatgtaagattgaggcagcagctaacatgtggcaggagatgagtatttgcagctcattaattatcaggctgaatggtaaattaggctcaggttgttgatgaattttatgtaaagtacttgagattttcagtcatggtgtaaaaccagaattgataatttcactgaaatgctagttaataatctcataaaatgttgaggcctgagagtattcttgttagaattttatttttcacatatagacagaaaaagggtcctggggaaagctccaatgaggagttttcacttacagagactgaacacttgctgcaaactgtatgacagagaaggtttggttcagaaaggagttagcacaggtggaaaggcaggaaacctgtctcagaatagatcagtattttctttttcttttttttttttttgagacagtcttactctgttgcccaggctggagtggagtggtgtgatctcggttcactgcaacctctgcctcccaggttcaagtgattctcgtgcctcagcctcccgattagctgggattacaggcatgtgccaacacacctggctaattttttttgtatttttagcagagacggggttttgccatgttggccaggctggtctcaaactcccaacctcaggcaatccacccaccttggcctcccaaagtgctgggattacagacatgagccaccgtgcccagccagatcattctttatggacctcatctcaggtattttctgatgacgtatgtctcaagaagagttcctagtagcatctgtggtaccagttatggaattctgagtttctctactgttgactttttcaaagatcagggatccaggtctagcatcctcacaatttgtctaagtgctgaatgaatggagtacttagaaaaggcctctatttaagattaagaagactcggctagtttttgctttactagtacttcagagcttttagtgttattccttcttatcatgtagttttcagttctggttgcaaaggatttctttgaaaagggaacatttccagttactgttctttgttttcctgaaaagaaatgttttaagagcactaaagtgatctcaggatctagacaagccaggctatgagacagatttaggccaaagatgaatgaagatggataagttggctttatggcaaatgcctgtagactttgtgtatcaacaaaaacaaggcaggactgaaggcttttccctagctatgtgaactctaaggggttaccttgaacagtttcccagtccgtttagaaaatgttcagaagctacctttctactggtctgtttgctatttttaactgttccggtgacactgctataaatactaagacagtaacaatctgactgcttttaccttccctcacccagacaaccagccctttaggaagttgtataccaccatgcaccaattctttttaccacattgctcgcagactgagaaaggggaccactaagatttcagagattaattctatttaatgctttcccaagtctgaacaaactccttttagtgagccaaggaactgaatgattttcttctcagagtatctagaaagaacactatgtttgagtaaatcttttgtaaggagaataactgagatattgatttagaaggtcaccacagggccaccgtatgacctgccgtatgtttctggtgtgccacctgttgtagaattagtgaatcaactcataatgcctgatatgacatggccctttctgcactggcatttctctaattacgttgtttgtaaggaaaatagaataataagtgcttgacataattcagagctaaaaggcacttccttccaacattgacttactctattttaagataaaatctgccactgtgtattcctagaagagccagggcactgtctgtagggaaataaatcatcatcaagaataacttttctactccaaatgaaggtctatttaaatgtcccttacatactcctagatatgattcagaaatactagtaaggagcaggttttactatggaaattaaacatcattcacagtgccattcaaaaatatgaattatccctattcaaatcagtcagtagtcagcaggagcccacatacctgataagtttaaagtttactgacctaggctaggaaattctcagagaacatagaaggaacatttgtttcctaatacaaatgctgcctgttgcacggtggaaaatattttgtttgacaagatttcctgaatatctgagaactcatttcaagctataataatagcagagtatcttaatagttagtccaggaaggctcttagcattataagctagagatacagtagagctacacagagcatctttgcaattgtattagactcagctttgtgtatttggtttagaatttgatccatgagtcaagtagtcttaacagttaacatttaatgttccaattccactcagcttttcaaattttaaaaagagccaaaggcataaataagaggaattaatttacatgtggaattaagtatgattcattttaattgtcagtcatttcactgtacctgaatttctgaccaataactaccgagtgctaaacctgagtttgacctgcatttatttacaaggttccttatgggagcaagtgtccctttaacagaagcaaagataatcttatcgtagcagtttttaaaatagctaaaaacttgttgcagcttaaatggccaacaataaacaatgagacatctgatcagtcaggtggtatcagtgagattagtagctcttaaacagaacaattacgatgagaatgtaaaaattagaaaaaggtttctggtaggtagaaaatagcaaagaggtttatatgctatgattacaactgtgtaaagagtatttatgcatgtgggcaaaagtgagaagtatgaaaatagttccgtttggatgcgatgatgacgtgtggtacttttctgttatgtttttaaataattttctttgatgttatgttgaattttaaatgacgttgattataaatctaacactagcagaaatcttaaataattgaaaaacctggggttttttttcccatagttattcctcataaaattggccgagtcatagaaggaagtccggctgaccgctgtggaaaactgaaagttggagatcatatctctgcagtgaatgggcagtccattgttgaactgtctcatgataacattgttcagctgatcaaagatgctggtgtcaccgtcacactaacggtcattgctgaagaaggtaaggagccagtagacgcgcctgccccaagctgatctgagaggcacaaagcctgtgtgaggcagtggcctcctccagcactgccagaatcactgcggggatataactgtgtatgcacgctggagtcttattcttccccttttcaatttaatgaacttaaaaaacaacttattataaagttgtcagcagctcaagaaaaataatccagctagtgagtgtggaccgtttatttatgtgctagagaagcaagcacccagaagtgaaagagactggtagtacttttcagatcttattttcttaaaataatgtcttaagtcttcgcttaagtgagagaaaatcctttaaacagttcaaagaaagtcactgttgatatcaagtcttttatgtcaggcccatgccacagtgtgcctttccttggggacagggctttgttctgggcagccgctttgtaaacagggtaaaggagtgcgtgggaatggctagtaagtggggcataaaacacatactggcagccgtggagtctcccaaacatgtttaatgtcttgccttgctgtaaagctgccttttgatcattaagaatttctaattaggaaccatctttagccagtccatattctttgtgaattacaacataaccactatgtaatgctctcatttttcctgattttgcaaaactaacaaggagaagccaaaaacagaattatgaagggtcagtctttgatgttaaaattcctcatactataatgtgtattcatgttccattttctcccatgaccctctaatctagttggtttccaagtcttttatacttcctggttctaccttttgtttctgttcctaccacaccactctcatcatttatttctaaggtattacataaatctgttcaagatgctataggggttatttctgcatggacatgaattgacttcactgctcccttaggccctgtcgaattctgggcaggattccaagatgctgtgacatccctgcctttgttctttcccttctccattctgttcctatactcttctcagactctgctgattcttttctaaaataatcccttgtagaagctccactgcttccccactctctgcccagaaagtgttctgtgattttgctctcagccttttaaatgtacttctcagtattctctccacaccctctctaagctgggcctcactggcctctatgtacatggccttcccccgcaaccgcaactcccatagcacctcctatctctgcacttcactggacatcattcttacataaccatatccctatttaaatggtctgctctttgtaaacaaaaaacatattggttgactatgatactagatgctcagcattttttttttttttttgagacagggtctcactctgttgcccaggctggagtgcagtggcacagtcctggctcgctgcagtctcaacctcccgggctcaagtgatcctctgacctcagcgtcctgagtagctaggactacataatttttaattttttttttttttttttttgagataggggtctcactgtgttgcgtagtctggtctcgaactcctgggctcaagcgatcttcctgcctcagcctcccacagtgctagtattacaggcgtgagccaccatgcctggccagcaaatattttttgaatgaaggaatgagtaaacgaatgagtgaacaaagtaaaagttaggagatgttagttctgagggcttctgtcccattacctaagcagaggctatttaaacccaataaaagaagtaaggcttttgacaaaggccacagatacctattagctagttacatgacaaaaaaactacataatatttctaatcttcacttttttaactgtagaactggagtagtaatatctatttcagtatcatcatcaggggttaaaggtgaaaatatacataaactgcataaataccctagggtgctcatctaatatcattattttacctacatgactggctccctcattcaggtctctgtttaaatctcacttcccaaggaaataataatagtatttaataagtgtgtactatgtgacaggcactgtcctaaatgcttgacatatattaactaatacaataatcctaggcaggcactatggttttccaattcttgtagatgaggaaactgagtcacagagcagttagatgaattgcctgtggttaaaaaatgttctaaatgcttactctcaatatctatgtatctcgtctatgaaccacactttgggtagccttgggatagattgttaggaaaaaaaactacttctttctccagtaacttttcccccaaaattactgtttaatgttgatggtattttctccaagagattatccaagattgttcataatttttcttagaataaaagttccctttcacattctggcccaaacacttgtggacagacacttaagatttcctgtgtaacgtcagtttgtgtgcagagaaaagagaagggtggagggaagctccctagaagatatatacttaaagtatatttcatatgcagccacagcctcttaaaatacagtcacattttatatgttaaatcacatttcactgatcacacactattttattatgctctaggttttttttaaactatgaaaacatccagaatctcttatttttcttaggaaaaaacagaaaatcttccttctgtccataaagatctcattcatggagtttgtaagccttccaggttctcataaaattcagtataaaatctatcaactgcattaatgagtcaaatgaatatttataactctaaagctattttcagaaaccacacattcagatcaataccttagggcagcagagcttcccatctgatacttctccccttctctccatcagccattccccattgacaggtaaaagacagttacctagaaaatgaacaactcttggtccctccatccttttttccccctttgctagatgctgtttaatatttgtgcctatgttgccaaggatatggtaaggcaagtgtcatatttcataaaagacttccaaactgtagccaggacttgagactgttctctatcatatggcattccccacaacactaccgcctcttcctctgccatggtatcttgtttttaaatatggaacataaatttactatatctggtagttcctgcttactgtaaaaaaaaacttaaattatataatttttcaaaattaatttcaaattttttgtcaggccttgttaattttaagagtgaacatgacttaccaaaggctaccaagcactcctgttggaattgattctggtagtgttgcaatacttttgttttgttttgttttcagttgatttatctgtttattcccatttgtctccattttccattctcatttctctcactgctcccattggcaagcattctagtatgttttatgtactgcattttatttgtacatcttttaaaatacattttttgttgtgtgttggcatttatttttgagttacgtaaatgttatggattttacactgggtttttctcagaaccatgttgttgttgttttcttttaatgccattttactgttctaagatccaatccagtattcctcttgacatttagctgttgtcttttttttctttttaattgggatagacttcatatactataaaattaatcattctaaaatatacaatttggcctggcgccgtggctcatgcctgtaatcccagcactttgggaggccaaggcaggcggatcaactgaggtcgggagttcaagaccaacctgaccaacatggagaaaccccacctctactaaaaatacaaaattagccaggcgtgatggcatgtgcctgtaatcccagctactcgggaggctgaggcaggagaatcacttgaacccgggaggcagaggttgctgtgagctgagattgcgccattgcactccagcctgggcaacaagagtgaaactccatctcaaaaacagaaatatatatatatatatatatatgcatttcagtggtttttagtatattcacagggttttgcaatcattaccactagttccacattttattgctccaaaaagaaacttcatacccattagaaatcacttcccattctctcgaaacccccatccctaggcaaccacttatccactttctgtctctgtggatttgctgggtatttcatataaatagaatcatacaatatgtggccttttgtgtctggcttctttcatctggcaaaatgttttcaaggtacgtcctagttgtagcatgcatcagtactgcattcctttttatgactaatgaacaatatttcattatgcatacatatatttttcttacctattaatcatttgatagacatttcagttgtttctactactgtgaataatgccactacaaatgctgttttataggtttttgtgttgttttatgatttcatttttcttggtcgtatacctaggagtggaattgttgggtcgcatggtaactatgtttagctttttgaagaacttcaaaactgttttccacagcagctgcacccttttatattcccaccagcaatgtatgaggcttccatttccccatatccttgccaacacttattttctgtttcaggggtttgttttctagccattctagtgggtatgaaatggtatttcattgtggttttgattggcattttgctgatgagtaatgatgttgaacatctttttcatgtgcttattgactatttgtaaatcttctttacatagagaaatgtctatttaaatcctttgccatttataactcagttatttgtcttttttattgttgaattgttttctgaatactagacctttatcagatacatggtttgcaagtatttttctcccattctccatttgtctttttactttcttgatactatcctttgatgcacaaagttttaatgctgaagaaatctaattcctctatttacaggggcggtgcttgtgctttggtatcatagcatcatatgcttttaagatttatctgcattgctgggtgaccataattgattgcttttaactgcttgaccgttttccatgagtatttaccacaaataacctgtccacttccctatagacagtcacattgcctacaacactacagtattacaaacaattctataatacacatcttcacatatctatgttacaaaacagtgtgagaagccaggcattggtggcacatgcttgtagtcccagctacacaggaggatcacttcagcccagaagtttaggccagcctagataacatagcaagaccttatctcttaaaaaaataaaaaaacagtgtgagaatttctgggagtgaaattacttgatcagagggtatacatgtatttgatttaatattgtcagattgttgcatccatctactcccaccagcaaaacattgaggattctgatactgtacttccccaccagtactttgtattatcagcttttgaatttgctagcctaaagcatgaaggtgttgtcttattatttaatttgcatttctctgattgcccatgaatttcagcatctcttcatatgcttgagtttttttcttgtgggatttctgtgttgttgatatttattggatactcatgaattatatggacttcagtagtacagttttgttttagagactataaatatctatctttttctgccatctgtatgttctttgaccatggtaccctttattatacagaaattcttaatttagatgtaatcaaatttgtcactttttacctacagcttaaactcttgaggttttatttaagataagtcattttttccccacatcacagagatttttcttttatatgatctaataccagatttgtaattttgatttttgtacttaggtctttaatccatctggagcctacctttgtatgtagttttaggagggatgtagttttattttttattcttaagatgagccagatttcccaacaccagctattagacagcacttctttgccttatttatttgtgatgccatctctcctatatatcaacttcccctttaaacatgagtctccaagtcctctattctgttctattagtttatttgttcttgggctgatgatatgtgtgtgtgtgtattttttatttttttatctgtaagtttgtgatacatcctaatatatctgcttattagggaaaacctatctgtctccctgtttctcaaaattgactacatattcatggaacttttctatataaaattttagaacaaattattaagctcctccaaaaaaaatcaaagtgcagttttttggggatatattgtgtatacgcgtatataaatatatatgtgtgtatgtatatatattttgggggtggagaatatctttacatattaagtcatctcaccaaagatcatggactgtatttccaattattcagctcatcttttatgtcctttaatagagttttagagttctagtatgttctctcatagggttcttatttactcttggtaaggtgagtctcaatagattataatgtttattgctgtagtttaactgtggattttgtttttatcttttgaaaatacactttcttttaagtgtattattataggcataccttggagatactgcaggttcagttataggccactgccattaggtagtgaatattgcaataaagtgaatcacatgaactttttggttttctagtgcatatagaagttatatttacactatactgtagtctcttaagtgtgcaatagcagtatgtcttaaaaaacaatatacataccttaatgaaagtatactttattgctaagaaatgctaatgatcatctgggcctttagtaagtcttaatctttatgctgatggagggtcttgcctcgatgttgatggttgctgactgatttgggtggtagttactgaaggttgaggtggctgtagcaatttcttaaaataagacaataaagtctgccacattgactctttctttcaccaaagatctctctgtagcatgtgatgctgtttgatagcattttacccacagtaaaacttctttcaaaattggactttgtcctctcaaactttgcctctactttatcaactaaggttatgtactattctaaatcctttgtggtcatttcaacagtgttcacagcatcttcaccaggagtagattccatctcaagaagccacttctttgctcatccgtaggaagcaaatcctcacctgttcaagttttgtcatgagattacagcaattcagtcccaacttcaggctctacttctaattctgttccttgctgtttctaccacatctgcagttacttcctccactgaagtcttgaacctctcaaagtcatccatgggaactagaatcaaattattccaaattcccgttaatgttgatatttttgacctcttccccatgaatcacgaatgttcttaatgtcgtctagaaacctttccaggttttcagtttgctttgcctagacccgtagaaaaatcactatctgtggcagctatagacttaccaaatatatttcttaaaatactaagacttgaaagtcaaaattactccttgatccatgggctacagaatggatgttgtattggaactcatgaaaacaacatttatctccttgtatttctccatcagagctcttgagtgactaggtgctttgtcagtaagcagtaatattttgaaaggaatctttttttctgagcagtaggtctcaacagtgggattaaattattcagtaaatcatgctgtaaacagatgtgctgtcatccaggctttattgttccatttttagagcataggcagagtagatttagcataattcttaagggccctaagatttttggagtgtaaatgagcacatgaatttaccagctgcattagcccctagcaagagagtcagctgcctttgaagctttgaagccaggcattgacttctcctttctagctatgaaagtcctagatggcatcttcttctaataagaggctgttttgtctaccttgaaaatctgttgtttagtgtagccaccttcaccaatgatattagttgaatcttctggaaaagttgctgcagcttctgtatcagcacttgctgcttcaccttgcagttttatattatagagatgacttctttccttaaacctcatgaaccagcttcttctagcttcacacttttcttctgcagcttcctcagctctcagaatggaagaaagttagggccttgctctggattaggctttggcttatggaaatactgtggctggtttgatcttctatccagaccactaaaactttctccatatccagcaataaggctgtttcattttcttgtcactcatttgttcactggagtaatatttacaattttcttcaagaacttttcttttgcattcacaacttggctaactggtacaagaggtctagctttcagcctgtctcaggtctcaacaagccttcctcactaagcttaatcaagtctagcttttgacgtaaagtgagagatatgcaactctttctttcacttgaatacatagaggtcattgtagggttattaattggcatgatcaatattgtgcatctcagggaatagaggggcctgaggagagggagaaagatggggaaaggctagttgatggagccagcacacacatatttatcgattatgtttgccattttatatgggtgtgatttgtggcacccaaaaacaattagagacaagtaacttgaaattgacatacccagtaagcaaaggtggaagacctgggaatttccagtgggtacaagaatataaatatcaaagatcactgaccacagatcaccataacagatataataataatgaaaaagttagaaattttggaagaattaccaaaatgtgacacagagacatgaaagtgagcacatgctgttggaaaaatggcactaatagactcgcccaatgcagggttgccataaaccttcaatttataaaaaatgcaataaaatgaagtgtactaaaataaggcatacctatacttacagacagaaagcccagcaaaaatgtaattctcatcgaaggagagatatacttaacccattgctttactattttaagaattttcaaataaaattcagagagaagataggcctgtttgacattatggaataaatatttgactttgtgaagtaaaatagcttataacagaaaaaaaatggagaagccatgtagcacgggttgaaggactaaaaatgaaaagaatcccagtgataggaagttttacttaaatttgatgaagacaacaaaacaacaaaaaacatgtaacttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcagcctcccaaagtgctgggattacaggcgtgagccaccgcgcccggccaaaaacatgtaactttaaaagtaagcaccaatttgtggtacattttgcctggaactgaaatgtctcatctggaatggaaggtagaggaaaacttgaaattgatcagattacttctattgtcctgctctgatgttatacactcattacaatagccaagctagtaacgccgataaattatctctcttgaccacatgcaaaggtacaagtatctcccagtcatctcattggcaaatggaattttccccatcattttccatctccttaatagtaaccatgaatttacagcgaccgaagacaatcgaactctatactgggcagtaaagtttagagacaggtaacttgaaattgacatacccaggaagcaaatgtggaagaacttatggaaatttctagtgagtacaggaatatcgagataactgagatgtgattcttgcaatcaaggagttcagagtctagtaggagagacaggtgttctgccagctctgacacaatgtgggaaatgctgtgagaacattgtgatcacagtgtgcttaaggtgccaggtaggatttcacagaggaggtgacaatttgaacatgaggtgaaatggaaagccaggagtgcccaggtaacaagtatcttatgagcaagaaaacgtcaccataggttgtttttgtttgttagtttgagatagagtcttgctctgtcgcccaggctggagtgcagtggcatgatcttggctcattgcaacctccacctcctgggttcaaacgattctcctgcctcagcctcccaagtagctgggactacaggcacatgccaccacacccaactaatttttgtatttttagtagagacggggtttcaccatgttggccaggctggtcttgaactcctgacctcaggtgatccgcctgccttggcttcctgaagtgctgggattacaggcatgagccaccgcgcccagcccaccataggttttttacacaaggcagtggcatgtttcaacttatgtgttaaaactggagtctaaggtggcaaagagagcagttaggaggtcagtataagcagcttgttaaagttactcaagaaaaataaaattcatgatagcaatataaaagagcaacaaatttccaggtctccaaaaaaaaaaaaaaaaaaaaaagttcatagcccactctactcccaccctcccttcctggaatacttgaccttaaagaggaaacacaaccctctgggtaagttctggtccagaggttggttctgcatctccaggtctagtacacattgttaaatccatgttcacacccaagcccagcagccagagggcgtagaaatcctcaggggccacctggcttggccatataccatttcttcctcctgccactttgtactctctggcctgtgtttttagagtactctctagcttctagatacaagaaacttttcaataaaaataagcaatttatctgtgtttttagtctcacagcactttggaaagtaacaacttaacccaagcaataaaatagtgatgcatgtattgtagtaaagcctgaagtttcagctttctcaatggaaactgcttcttaattatctcttatctttaacatgagattttcactattgtattctaagattcaggttatatcagcttccacatgtttttctaacttaaagtaccctctacatttaacatttttataaagcaaggtaaagatttcagcatatatgtttaaagagaaatgcaaccccaagtgagagatatcattttgatgatgatgatgatgatgatgaaaatgatgatagttataatagaaactgttatattgtgactattatatgccaggcactattctaagcatgtatatttataagctcctttgatactataacccagtgagataactgtatttccccttttataggcaagacaattcaaagcacagagaacataacagattttctcaagaacacacagctagtaaatgatgcaatcaggcttaaaccctgtccatcttgctcagagttcatggtcttaatcattaagctgtgctccctctgatactttaaatatcctatgcttttatatttaaacataataaaatgttcaaaagtttcaacttcaaaaatatgagtctgccagccttaggcatcttgtttaattgtcgcctccttgccatctagttctaggtgcaggcagtcactatgcttagctatgaaagctaccttcgaggaacagcagggagtccagagctgttgggaatgatacaaaacaaatgtaatgtttttcacctatatttgtgttctgagaaaatggaagcagtagaatatttataaatatttgttagcactcaggattctataagtttgtctttggttctcagtggcaggcaaaataactgctcctatattgaagatgcaggttcaaaggtgtgagtgtggtttgcagactggcctccgtgttccagcattcctgagacccggctttgttatctagaatgggttaccaattattaggtgtgtgctctggaagcccatagaataggcaacagtatagttcctggagctctgtcttctagataaatattatgttcatttctgaattttatgttatatggatgactaaaacacaggtgaaaatggggacataatatgattcctgttctcctgagacataaacgttaatcaaaagccacagggaaaaagatgttaatgcgccagttccagacagctgacaatagtgctgttcatgctaaagccactaaagtcagtacagcaatagccatctgttattgtctcaccttcacagatccgcttggccttcacatttttatgtacaaattcttatttctattgttttctcatttgaacagagcatcatggtccaccatcaggaacaaactcagccaggcaaagcccagccctgcagcacaggcccatgggacagtcacaggccaaccacatacctggggacaggtggggctattttcaggtttttgtttttgtttttttcttattctctccttattgctctgctgttcataaccccactccccatcatccacccccatgcagtaatgcagatgccagctgttgaggtcaaaatgacaactcttgcctgttcctcaaataccgtccccatcacctccacccattcagtaccttcgtccctcttccagcctccatcccaggcacagcataattatccaatcttgcctgacatgcgaggattagaaagaaatgacatagcatctggctctgctactcttggtcctcatagttttcatagggaagctgcagacccatatggattgctgtcttatcagaccacctgagcagagcaggttttgtgtgtatttctgtcttctttcattgaaaatattagcctagatttccagaaatccagcatcttcacgggcattggtgctgcaggagagccatttttcactgtgacagggtcagcttaactgccctctggtgtagttatttgattgcagttttctttgatataaactgctctgagatgtccttaaaaaaattgtggatgttgacagacttcaaagtatgttggaattaatgaccaggtttctcctagcacccctctgatctgattttagatatagtctgtcttcatagtggtttgtcagagggaaaatggcaaggtcgagcttttaaaagaaaagaaattaatctgcctttagactgtttttcattttctcagttcagagagtgacttgatttctctctcttgtagaagtgccctagaaggtgaaattggaaaagatgtctccacttcttacagacattcttggtcagaccacaagcaccttgcacagcctgacaccgcagtaatttcagttgtaggcagtcggcacaatcaggtaaacaaacatttccccagatggggagtgatattttgagttgccataccactggcattggtgaatttttattgcaaatcagttcagataaatttgtttccaaaactaataattctcgaagacctgccatgtgtttggcattctgctggcattcataggagaatgttaggagtgaaagaaaagtttcccctacagcaggagagctttgaacccttggttaagtacttagaagtaaatagtattttagataatcaaattcaggtttttttgtttgttacttgtttgtttccaggaaaattagtcaaacgctacttaaaggaagcactttccaaaattctgttctctgattgttgcattgcacattgaccaactagaaaagacatgtaaccttcagattaatttaggctgcatttataaaaattaagtagccctttaaccaaaacctacattccttctttacaatatagaaatgcacattgagagtataaatcatttcttccagctatagaagtaatctttcttcaaaatgtaagtaaacagtccatgagaacttgcttttcttatacttctttctctctagaaccttggttgttatccagtagagctggagagaggcccccggggctttggattcagcctccgaggggggaaggagtacaacatggggctgttcatccttcgtcttgctgaagatggtcctgccatcaaagatggcagaattcatgtgagttggtttctgtctgtaaccttaggttcaggctctagactagaaacttcgaaagatattaataattgatttaaagggaatgcaggaacctcctaaatctaaaaagcaggatttgtcatcactggtagctaaaaaaggcaaatgcttgtcattttgcttttctaacgccctgatgatttcatttcttctcttcagtgtgctaaaccatattgcagttatgccacttttgccttcttgaccttggtcaataagaaaattcatttcttattcacatagtcaacatctgagggtaaacgaattaataaatacacttttcatcttaataagagtcttgagaaagcgaggatcaaatagaatctttaactttttccaggaggcaataggcccaggattttttttccccactcttagctaccgggagaggtaactagaggctgaaaagcgtggctctcaacatttcttattgtttgaaggcctagaattcacatcagtagtattccatcatagatgttctcaactctgaaacactgtgacttcgtatagggaactgcagaccaaattgtttatagatctgcataagatagtttttccttcttctctggatgttaattaaagaggaatcttatatagaagacatttgctgctgggcgcggtggctcacgcctgtaatcccagcactttgggaggccgaggtgggcagatcgcctgaggtcgggagttcgagaccagcctgaccaacatggagaaaccccgtctgtactaaaaatacaaaaattagccgggcctggtggtgcatgcctgtaatcccagctacttgggaggctgaggcaggagaatcacttgaacctgggaggcagaggtcggagtgtgccgagatcacaccattgcactctagtctgggcaacaagagcaaaactccatttaaaaaaaaaaaaaaaaagacatttgctgtcttcaatttaaaaaaaaaaaaaacttaactcactggcattcagttaggtgatacattaaaaacttttaatttctagacaccgttccccctactactcaaaagaattttggatttcctttccctgccaccagtaggcatcagagaaaaggaactttttttttttaattttaaactaagtaattcaattagaaaggcaaatgatcctggtaattattagatggtatattctagtaattattagaaaaggtgcttctgggtgattgcagttttgaatttttcatttcactcccattagtcatttcataaacacatattgagtgtttgcattacccaaagctttatgcatgctactgaatgagttgggagagtgactcaaaacaaataagatattatcctccctcaaaatgaccagacacatgcacaagttcaaagggatgaatagagaagatttcacagaataggtggcattgacaggtgcataggatttcaatagggagaaattaaggagagaaaacattccaggctgaataaatgagcaatggcgtaaaactaaggaagtataagtcatgtacagggaacttcaaatggttgagtttacttagattttatttagaaaatgcgtagatgaatagaggaaatgagaatataaaagccgatgggtcgcaggcataaaggtcctaggcagtgggaagccatgggaggctttttagccaggagtttcccctcagagcaatctgctgataaaaatctgttagtggtgtgcaggaaggatgaagggactccaggtagctgtaatttatgcatacagtggtagtggtgggagtataacttgaatggtaacgctttggatggaagataagagatgcatataagttcaaatttcagtgaataaaggaccagactagatgaacaacaagtatcctttaaatgagggatgaaggaaaaggaagagtaaaggatgactcagaagccttgccccatctgtactacgaaaaccatcagggaagccaaggggagaaaggatatggcaaagactgatggtgtagtaagttggagtcatgttgaggtgaagggaacagctagtagagcaggtgtaaatgtttagcaggcaattactactagtagtggtagaagcccagattgcgacattactgagaagtgatgattgaaacctttgtggtagataagatcactaaggaagaatatttagagagtacttagccaagggcagagctctgagcaaggcatgtaattagtggactagataaaataaagaaaatgggaaggcgcagcatgcagagccacagagccaaagctgcagagtgtttatgacaaagagggaccgatggccttaatacagctcgtcaagaactgctgaatctactttcttatagagacaatttcatatcgtgacaagaacatgggtttggaaatcagacaggacattctcctgagtttcctcatctgcaaaatgcagaaccatatgtaatatacatggtccaagtaaacttcttaaagtcttaataagagcatcttgagacactgtttacagaggatggcatatttattcctggttttcttggtcctttcccctcccctcccctcctatcttctcttctctctctctctctcatctctctctctctctgtctctctctcacacacacaacctattcagttactttacatctgtgtttcaatgcttctattgtaaatagtgtcacaaaaatccaattaaatgataaattaggatataattgttttaaatgttggttccaaatataaccctcagatccactaatctcagtaaaccaaaggcaaacaggccttaaagcaaagtctagttctaaacatgtcattctcagccaggagtggtggcacatgcttgtaatcccagctacttgggaggctgaggtgggagggttacttgagcccaggagttcaagaccagtctgggcaacacagcaaaacatcctcagttaaaaaacgacaacatgacatgctttatgaatgagcagaaactttagaatctaatgatgaaatcagcttttatttcaagaataaactctgaaaacaaaagcaaatgagcaattaactgttagaccccagtgtgctctaacctgtaagaaaatgtcagcttttcagagaagtcactttttgggctattaaattatcaaaatcttgacttgatacagctcatgagggctttgcatataactagtgctcaataaaatgttattgatgacaactttctctggtggccgctgtccaaatgataagagtttatctctagctgacactcgcaccacggagccacctgagtgcccctctctgcctcccccgcttgcctctcctcttctccctttattaggttgacagctgtactttgtgtcctatacctattattccgtatctccagcacctgatatggtgccttgaatattcatatcaggtgctccatagatatttgttgaaagagtaaaatgtatggataataattctagatactgagagaattattgtgtgtgtgtgtttttatttttaagatcagttcccaggacttattactgggtgaacaggactggggatatatgaagtaattagcaacaatcttagtgtcattaagaaaacaagaaatgttaatttgtaacatagatggaaggatattgagaatcattgagaggttcttcctttcggtctggttaagatttagagaggagagagaaaaaaagtgttctgggataaggaactgagaaatagctgaatggaaaaggttcatattagggaatagtgtcaaacttaaatatttaacgtagaacataatcagatttagaaaatattaagtgtttgctgtctttgaggcaacatgtattttcctacacaacatgcgtttttacttatattagtctcaaaaactctgagataggtgacattatccccacttacagatttaaaactgaggctcaaggagacttagtcacttgcagagatcactcatcctgtgcaggccacagtgtgacccaggtatgaccctagtccgtcgtcctcgaagatcggttcatgtgctttccgctatgtcaggtcttggcttgagtccagtttggattggatttcattgataggcagacagtttcttaacaggttgtgagataatataagccatgtggtagaaatattttgtcattttaatacatttgtagtggatgttgtttttaaaacgacaagactgcctataaaaaaatagtgatttgtttaaaaaagggaacattctttttccctattcttcctacttcttttcttttggttctcctattttttttcctttctcttttctttcctctctcttctctgtccccataattatttttcaataatacaaaactgaacttgaatctttgttctatttatcaaaagatgttttctccaaattattttttatcacatttttaaagtgacttaaaatgttaaaaggatgtttactgggtgaatttactcctctgaatttccctctcagaagagtctttttcatctgtagttttgtgtatgtaggtctctgcagaatttctcccactctgagggcctgtctaccataaatcttaaagcaatggctccccctccttcccctcattcagttttaaagttaaacagaaatgacacctggtggcaagtctgttcaattacaagtttttgttgttttttttttttgcagtttattgcaggaaaagaataaaaagtgttctgggttggagagcttaagctaaagaatgtgattgaaataaattataacctcaaacctgttttacaagatatgcccaaagcagtgtccaaatactatctactttaattttctttatcagcaagattatatatctagtgctaatttcttacctacattgcctcatgaaaatgattcttcttccatcatttatcaagggaaatctaagtattggcttttgtttcacttatatattctggatagtaaggggtttctaaattattctccatcctgctgtcttactttggttttattaaggtgttttcatcttacatattaaatccatcaatcttgtttctgatattgtccatttgttcaagagtaagcctcccttgtttaaaataagtatgcaataagacctttagtctatttcatagttgacttgaatttttttgcattgtatagaatggagtgcagtctacagttaaatcttcgtaatgatacactttaaaatagcttgaaaactaatatttgcacttggtatataatcatgttttatcttaagtcctcccagaatcccacgaaataggtactaatattatcctcatttaacagatgaaaaaaatgagaccacaacactagaaagaggtggagcacaagatgtgaaccacagcctcctgaccgcctgtgccatgctgtatctgtagaaagagttggcccactgacctttgttaaatattgagtccttctgttttgttacttctggattggcttattattatttctattctttagtcaccttgcagctagcttcaactcaaaggaacttctggattgttttagtaagctcttacaaatatttgagtatttgctttttggaatttcagtaatatgccattgtctaatttttctgttttgaagccagtatccttcattttacatgtcaccttgaaatatattttttcaacttttttttaataagttcagtgcggcacatgtacaggtttgttacacaggtatattgcatgattctgaggcttagaatatgaatgagttcccatctcccaggtagtgggcatagtacccaataggcagttttttagcccttgaccctctccttccctccccccatcttgtattcccgtgtctgttgttctcatctttgtgtccatgtgtactcagtgtttagctcccaattacaattgagaacatgaggtatttggttttctgtttctgcgttagtttgcttaggataatgatggcctccagctccatccatgttgctgtaaggggacatgatttcgctctttttatggctgcatagtattctatggtgtgtatataccacattttctttatccaatgcagcattcatcaacatgtgtttgcttgaaatagatttaaaatcagtaccatcattatgtttaattaggtctgttccaaagttatacttgacttttacatattttccctttttcttttaaaataactcagacatttctagtaaatcacaatggtactaaggtatatcttattctgatccctagttttatgtttattttcctgaaaaatgatttttttttttttttgagacggagtttcgctcgctgcccagactggagtgcagtggtgcaatctcggctcattgcaacctccacctcccaggttcaagtaattctcttgcctcagcctcccaagtagctgggattacaggcatgcgccaccacacctggccaattttgtatttttagtagagaccgggtttctccatgttggtcaggctggtctcgaactcccgacctcaggtgatccaccagcctcagcctcccagagagctgggattacaggtgtgagccaccatccctggccctgagaaatgattttacactaacatcactaagtttatgccagttactggttttaaataagtgttcatattaatctattctccaagtttaagtttttaagaattttaatctataaagatgtcatttattcaaatacctcatgtatgtacaggacatagcagcagttcaaaggaatgagcagttctccctggaggccaggaaaggcttcaaagataagagccctctgcccaggttttaggagatatatttaaaattcagctcaagtttgaaagtacccttcacattcggacatagctctgtagtatcatttggattgttgtttgtaaaatgtctaacatgtacccagtgctctcctgcgagagttgataagaggacagatggcagcaacaggaagagacaatgtccaggtttactcacgcataaaaaccctacacagcaagtgcccaggtttacttatgaaaatcctacacagggccgggcgcggtggctcacgcctgtaatcccagcactttaggaggctgaggcgggcggatcacgaggtcaggagatcgagaccatcctggctaacacggtgaaaccccatctctactaaaaatacaaaaaattagccgggcgtggtggcgggcgcctgtagtcccaactactcgggaggctgaggtagtagaatggcgtgaacccaggaggcggagcttgcagtgagccgaggtctcgccactgcactccagcctgggcgacagagcaagactccgtctcaaaaagcaaaacaaaacaaacaaacaaaaaatcctacacaggaaagttttatatggctattaaagatctgggcatcttcaaatcaagaaccaaattctagaatttgattaacattctaaatttgatttctataaatttagaaaattccaaatctgattctagaatttgattcttgatttcaagatgtccagatcttagttagtagccatataaaactttcctgtgtaggatttttgtgagtaaacctgaacattgccacttcctgttgtttgttgtcatctgtcctctcatcaactctcacatggcagtactgggtacacgttaggtattttacaaacgaaagaatcacttagcaaggttgaatggctcaagagctgacaaaagcagaatttacaaaggatgcatagtttcatgttgttcctgtgaatgttctctgtctaggttggtgaccagattgttgaaatcaatggggaacctacacaaggaatcacacatactcgagcaattgagctcattcaggctggtggaaataaagttcttcttcttttgaggccaggaactggcttgatacctgaccatggtaagtaaagtagcccactagtagctgaaaagttgtatattagggaggggacagaagaaaaaggaatatatatttggagaggatagatattttactagttaattcagaggtgaatgctagaaccatgaaaagctagttacatagcagagttatcataaatagtattagaaaacaagtgacttaggcaggactttcgttggaatggaatgtattttaaatttaatcagaaaaaacatatagttgtttttgtagagaaatgtacctattaaaaaagtgtattagaggcaaacaatttaaataccataaaaaatgttttaaatctcttcaaaatatcccagctttttctcttacttagctaattacacattaccaaccaatatttttatttctgtaaagcaagataagtttatattataatgaatgcgcagcatgaaaacttaggcttttctggtgactcggcaaaaacaagttgctatcaccctacctggagacagggagttggacctgagaccatttctgtcctgtattaatgttaaacttcctgggtttccatggcatgttttgaaatatcatggtatttgaaagtcactgttttttgagtgcactattctagaaataaaggcagtaccacacccacgcagtacttgcctcatctagctccccacctcctgccctaccccaccccaccccaccgcttttgagggataagtgtagacataacctcctacagtacccttccagcttatgattctctgactgtattatcttccaccatctgcttgtaaatcatatgttcccagtgacatctttgctaactgcactgattttttttttttttttcacatagtcctaggctttttctcttccctcttcaggtttggctccttccggtctgtgctcctacgtgaaacccgagcaacattaaggctttcagggcttttcttggtctttccttaaaaagacttggtaaatttgcatgtcttgtaaatcactttcttcttttgttttcttttaaattaaaaatgatgctattaaatacatctatttctatcttctgcacttttcagtcttcttttgacattaaatttgacagcttaatgcaagagaattattacaaatgcccatgagcctcattctggttaccacagtttggtttcctttattaattagtgattttgccatatcctaaactgtatcaattcataataattagtgagcttcttgggccacgtaatttggttcagctttataacttgtaagttctaattgggctttactaatagagaatttacagatcatatattatctcactaattatatgtaattggaaaaaatgaatattattttgtgtatataaacaacccatccttcatgtatgaacagatgtctgtacacatccgcctttatagagagatatgttgtaaacatatacaaactgtataaaatactcaggctttttaagcagttacgacaattcaaatggctgtcaaagttcaaaacgtattgttcctatttgtaattctaaaatttaataatgttccattcaaatcacttttttaggtgattgggatattaataatccttcgtcttcaaatgtgatttatgatgaacagtcaccattacccccatcttcacattttgcttccatatttgaagagtctcacgtgccagtaattgaagaatctttgagagttcagatatgtgaaaaggcagaagaattaaaggacattgtgcctgaaaagaaaagcactttaaatgaaaatcagcctgagataaagcatcagtctcttctccagaaaaatgtgagtaagagggatccacccagcagtcatgggcacagtaacaagaaaaatctattaaaagtagaaaatggtgttacacgaagaggtagatcggttagtcccaaaaagccagccagtcaacattcagaggaacatttggataagattcctagtcctctaaaaaataaccccaaaagaagacccagagatcaatccctcagccccagcaaaggggaaaataaaagttgtcaggtcagcaccagggcaggctctggacaagatcagtgcagaaaaagcagaggtcggtcggccagcccaaaaaagcagcaaaaaattgaaggaagcaaagctccatcaaatgctgaggccaaattattagagggtaagagtcgaagaatagcaggctatacgggcagtaatgctgagcagatcccagatgggaaggaaaaatcagacgtcatcaggaaagatgcaaagcagaatcagttggaaaaaagcagaacaaggtctccagagaaaaaaatcaaaagaatggttgagaaatctcttccatccaaaatgactaataagactacaagtaaagaagtatctgaaaatgaaaaaggaaagaaagtaaccacaggagaaacaagttctagtaacgataaaataggagaaaatgtccagctatcagaaaagaggctgaagcaagaacctgaagagaaggtagtttcaaacaaaacagaagatcacaaagggaaagaactagaggcagctgacaaaaacaaagagactggaaggttcaaaccggaaagcagttctccagttaagaaaacactgataactccagggccctggaaggttccaagtggaaataaagtcacaggcactattggtatggctgagaaacggcagtaacctttagtataaaacaaagaaaaacaagttgtaatcttttcttacagcagcatttttccagaaaaagcctttttttttttttcagatattctgaaacagataagtacatgttaatgtgagcctcaagttacctaggctgcatgaagggcctttaggattgctaagaaccaactgtccccctggccggctgccctccctcgctctcaggaaggagctgcatccacatgctcatctgacccgccctgctcaggctgcccagctcgtcttcatgagtgtctgaacaaatgacatatgttgatattaacaatgtggtcacaactcactttgtatttgtgccaagttatctactgtatcatgtctgtttttatcctttttgttcagctgtttccacagtaatgaaaaagttaggtttggcttggaagttgatgatctcaatagcatgttgcatgtttacagagagaaatatgtgagtccttgcagaagaagagactgttaactcatcgttaaagatggccgttgtctcttctaacagctactgatgatgtcccactttaaaaataaaacccccaaacatcactactttaaggaaaaaaaaaatgtagtccaatattgatgctttcttatggctttttattttaatttggctggataagttgtttcaaataactgttaaagatattacttacaattgaatgtttgaaataagaaagtactttaagcaatagagttcatctcctgctgtgttatccaacctcgatgtatacttacagcatctcaggtcaccctttttatttcagttatttaattatgaaaccataaagaagcatgtggaaatagtgtttattgctctttgaagaaaaaccaccaactatttctggatattttggctgtacctactactaaagtcattagtctttaatacataatacatatttgaaaagtaaacatattatatagattatgtgagggacttaatcatgaaaccagtttcacagtccaagtaccaactcttctggtagcaggtgcacaagcttgggtgtttaaaaacaacctgtgtagggtatgcccagcaaatgaggacaaatgtgtagacagtacttactggatcttatttaacttttagctacattaactaactttcttatttaaaaacaagaaagggagactaaacatctgcttaacttgtacacattttcagaattctttttaaaagtctagttaaagatgtttcttagaagttggagactgttaacaacttccataaaatagatccaggtttttcagttccctgaagcagcattcagtagcatctatataaataaaggcaccttctgagaataaaactattttatggagtgtgtgaacacacttgttctgtcacctgggttcatcttgttgtgaagcacattaggtccaggtccttccctctgggagtctgactgtgaaactctttaacccaacaactcaattagcccctgtagataagacatgcttcccagagtgagatttttgaaatccccttttcatccagaactatatttacccacctattgtaactattcaaatagagcaaaattaggaggcttgataaatactaagaatttagtaccacagaaattatttattattttccctgtagtccacaattagtgataacgaatcctatttttgttaactgtgacataactttgatgtcatatgttgtcctatgtggttcttcctaagtaaactctgtactgattatatactgacttagcaatgtggccttggaatgctgagcaaaatgtggatgtactggttgtaaatgtttatatattgtacagtacctttatatatacacttgaggttctgattagagaaagatctgtaaattgctcattattttttatatagatatttaaaaaaaaca

SEQ ID NO: 788 - DNA, 295072 bp, Homo sapiens; identical to SEQ ID NO: 787

SEQ ID NO: 789 - DNA, 310065 bp, Homo sapiens
cagtctggggcgggcgctcgggctgcgcgggctctgggcagcagcagcagcagcagcagcatcctctcttcctttacttcccttccgcttctttctcttccttctccttctttttcccccccctccccttcttcccctaacccttctacccctctcctttttctccggagggcgctaagtccgtgagcggtggcagtcgcgaccgcgggtgcatccagtttctgcgcccaggtaagagaccgtccccacctctggctctatgtagggcgcctctccttttgcctcggtctctgagtagaaagagataggaatggggaggggttgtgtctcgtcctctgggactcgcagcaggcagtctggtagttggtcgagtggccagccgtgcacctggcggaagattcgggcctgtcctctccaggtgtcactgcggagcagggggccggacgctactggtacctgagccctggcttcgtagaagagcgagtgagcttgttaggtaccactttgaaacaactgaaaacttacgccaggttagaatacgtgtatcgaaagccagtattacctgcgctgtggaaagaaggggagtggattctacaaagatagtggaaaataggaaatcgaggtaggggatttttttgttcatccagctgcagagaactgcacactgggaagtgagtgagtgagggaagccttgtccatttcaaatcatgtttctctgtaattccttcagaaacagctgggagaggaggactgatatttataattgtaggaaaatgaaaaataaatgcctggtggtgttggagggcggggcacgaagaaatgagtctggttaggcttccacacagtcgtttttctttttaaacgttgggggtggacctctgaatctacagtgcatctattcttttcttccttttctttttaaaaggcttttttggtggggagaggaggactgcagtgctggctgcctgccttcccccacctcgtcttttgtttaaggatggaaatttcaagaaagagtgtgtggggggctaggagtggggagctgtatatttgggtgtgtatagggggaggggtatggatggagtcagaaaaaaaatccttgaaaactggaaattaatgttattctgcctggcatccggacttcaggatttttgtcagaaaataaaaagctttcattagcaacaagcccgtttgtgacaattgctgtgtgccatctgtcgtaagctcttagcacaatgcttccaggacatagacgctttaaaattgagtccggtgtaaagggtttttgtttaaatgcctaaacacacaagtatgcacacaaatgtataatacactatatacatgttacaaaaggaaataggtacttaagagactgattttttaaaattgtatttgagggtttggaaattatgttgtgaataaaatctgtagtgcaaaacaaaaaaatattgttgggtggtatataattttgggtgtgaggcaaagggattgatgactgttggtaaggaactaatttaaatgttaaaggtataatttattttaaaatgatcagtctagaaaaggaaatgattgcaaactgaaattgaggtttgcagccacagtgaggcgatggagaacaaagccttctatgtgagccacattatgcaaaatgtcccatgcatgagctgcaggtaccagcccagttcaaaagcatagttctttcactatgtcatttcactgtggacaattatgattttttttggcagtcaaatagattgaataaatagaagccctttagaatgcttttaattttatgcccagggaaaagattacagccttccatcagaatataacacaaagcagccctttaaccgggcaataggtgtattttggtagaaatccttgtgaatttgcaaatcatggatgttccaaaagccccagccccatgcacacaaagaacccttccttcaagaaaaaaggcatttttctcattcagtaaggattattatatttgtgtgtgtatgtttatgttgatttcctggtaatttcatctgattatcataggtgtacatctgcattcatgatttgtatattatcagagccattgtggctttaggatcagtggtacatgctgtttatctgtggtttatttaattttaatttttcatattttacagtttgctacaatattatttaatgtccaaagttttcttttttaaaaccataagtagaaaattgcttaacacacatctgaagatctaagtaatttaaaaatagagctaccttttataaaataatattttagttatattaatttttattttatttatctcctctcttatttttttcccttttctaatcaaataacctgtttctttatggctgctttagtcttctatactgccataggagggccagtgttttcaagaattttgaatttaggattgttcattctctgcagcacctctcaggatgacttgtttacagcaccttctcagggaggagacagggaaagaatgtgctgaaagagcatgacccagtgaaactggcacagccattacctcatcctagtaggtacttcagattcattgagagagcaggcatcctctcagtggaaaccaaacaccaggagcacacccatctcagggcaaaagcctttctcttcccatagcagcctttactaatgtcattccactgaggttaaagggatattttctcttttatgtattccttttcagggatcttgaacttggttagaaatatgtagccagaaatgaaacttggcacagaatcctctaagcctgaaggaataatttcattcctttaccccttttggtttaaaccagttcgcaaattttctaaacatcagaagggaaaaggaagaaaaatgttggtgtatttttgtgtattttcttatcacacacacatattttgtattgaattttactagcagttagacaacagactggacatgctattaacaaatgtagttgcactgttggcattttaaaaaatcattattacatttgcttataggacaataggtgcatccttcagtgattcattgatgtccttttgagactgaccatatgaaactgacatggggattttagtattcaagttggtaactctgattattgaatcctttcaatacttaatttcctcttaacagattaagataaagaatctgaaataatagttacagtagaagatagcaccacccccagatcaatactatcctccttaatgctaaaagtagtcactttaggtaagtcattagtaaatgcatgaacctgaagataacagttttgaaacaatctcaaatttttttgtctctgttatagattagttaaagatgctaataaactctttgagtcatatctgattctctcagatatatcaagtgtttttgctactttaattatctctttactattgccattacctttatctactcaatctagaccttttcatgtaaggactgtattttgatcatttcaccatattttccctcccttcacatcattctttttaattcgacatttggatgttagacttactgttctctagctattttggtttcagtaatgttactctcttgatacaaatttggcctttatttttcattaaggagagcacttattaccatttatgtatttatttattcattatgagaaacaacttttgatattctcagttttcaattgcagaaaatgattctaggcaccaaaagcagttaaaagtctgcaaattaatatgtagtacacaaaaggccaaagtcaagggagacagtctgtatgaaggtttgggtgggtgggtaggtgggtgggcgtagaggaagatgtggaatgaaagcaaattctcagctattaaaagctgtccatgtagggtagagatgagcctttttgtctaagagggtgaagaaggaataaatgttttgtttttctgtttcaacatattttgtccccatccctcccctgtcatgtctttgaactaaggccatggtgcttccttataaaaattatacagtatgtttattggaaggagttttacagtgaattaggtgaattcagaattttaaaatgatgtgaacacaattagatgaatttttatgaaaaacactttgaatctaatctttgatctttcctgttcaagacataagctttcctttgaatggtagtactttaactgtaatacattttacttaaacatttcagtaaaattctatggaaagttagacaaaataaagagctcaggatcctctttcagtctactgttaagtttatattgtggaagttggggaaagttttagacagtttgttttccgttaaaacacacactagagggggcaaatttctttttttttttttttgctttttgttatgttaatgagcaaataatttacttttaagatcacataccttgacttttttctttccttttttgtcttctttccattctcctctttcccttttcttttcttctttacttagattgctcctttctttcagtttgtattggcaaaataaacattggtctttagaaaatgaaattatagcctgatattcttattgaaatttatttttcattatatttatatttctcatttaacatgaagttttatgctaacctctcctccttctcaaggctccatccctatcttggtcctttctttgaacttggcttttatatcccctaggcttcaacagttttttccttgtataccaatctttcataacgctttgtacctcaaaaaggcctttaaaaaccagaagaaaagttactaccctatttctcccgattagtttgtatccaagtttattcaggttcccttaggttataggtaattgctcgcctcaatgtgtcctcattagccttctttgaattactttattttattttatttatttatttatttatttatttatttatttatttatttattttgagacggagtctcgctctttcgcccaggccggagtacagtggcgccatctcggctcactgcaagctccgccccccgggttcacgccattctcctgcctcagcctcccgagtagctgggactacaggcgcccgccaccgctcccggctaattttttgtatttttagtagagacagggtttcaccttgttagccaggatgatctcgatctcctgacctcgtgatccgcccgcctcagcctcccaaagtgctgggattacagtcatgagccaccgtgcccggcaattactttaaagacattttcagacaaaagtaatacatgtatacaacgaatttttttaaataaaaaatttggctagccaactgactttttattattttgttcatcagacactataaaacatggttcaactagttttttttttttaacaactagtaaagttactatgtgtcaggcagtccattgtctttatgttagttaactagttccactaatgtgtacctattaagtgaagtatgaactactctatgagcaatcagtaaatgttgaactaaattaatttaattttaagtaaaatattcctaattacatttctctgtatagcatcatcattagccatcttaatctacctcaaaaatgaccataaaatacagtgcttgaatatcatgagatatttcatcgcttaactgtctaggtcctttacagttaaagcaaactcacaagtaaatatacaaactgactctatttgagacaaaaccatcatttcaatatgaaccctttacatttatttaagtagtaatggattttaggtggctactacctttgcattacaacaatttaaaagtacaacattgtgttgttaatgcatggtgctgaaattacataatgaattggcatgagaaagtgttcatcaattttaaaatgaataatatggtatcattttgattggtattaaggcaattaaataatgctcggctttgacattttactattttatttgggtattgtacctctcaaattggtaattttctcttcccttaagagtctacctttttgagcaaaataatgtattaagtaataggctgcctattttttattgttgtttatatgattcactacgtccttttggcccactttgaaaaacaagcaaaaaagtttttaggattcagttattcattctttttatcttaataggtcatctagtatagccaggaaaatatttgattctttaatttgctacaaaacttatttattgtttgaacaaaattttcaatctgtagcatacaatttctttacttagtggatgagaacatggaattataatacttgtaacaacttctcagcctgctaattttgtctacctggtgtttcacaagggctaacatgatggtggcagtggtggtatttgtgtgtttgtgtataattactttctaagatagagttagacttttatatatttgcttttttcattggtgaaatcaattattatgcaatcagttgattccacatgagaacagttggtattaaatacaatttaatagggaaaacaatgaccaagtatttattaatgaaatcaaattagattaatattaaagtattgctgtatttttctgtttggattaagatagtccagattccattgttcattattgaaatcaaatggtaaagctaaatcttgtgctcaaaattaaaacatctccatgttgatcaaaatgtcctaagttggaatactggctacttaaatgtatcttttaagaagttcaggtgacactgcttttacatggaaaatgccctttatcttcacttaaacatcagaaaccaggactgatggaacttttaagaattttgctgctaggagaacataaaatactaagcatctactgaaacctgaatctcttataaaacaaccaagtgactatgatctaggacttatttaaaagatctttggccactgtatctcagactaaagttttgccttattcgggatgaagattatttcagagcactgagtggcctttggtgaaacttaacagtttttttcatttgtttaagttcttatagctttaaaactcagtcacgaatttcatgctttttcttcttttgtcttcagtagcaccatattgagagtggtcaatatcaaaactggcagtatgaagctttgtacaatcctggacattcttactgccttatttagtcgcttcccaaatggtatcatgagggtattaataggaatgcaaagttctccattaaaaaaatggcatttaaaatggataaactgatttttaataaaatctttttattcctaacatatttatgatttatgtaatggaataactttttgtagccctgttaattactggattagaaggactgtgtgtttacatatctggaaatatttaaaatgctattaaatgcattctttttgtaattagttaattattttttacatttacaaatgagagttacaaatacattctttatttctgtgcctctgccccatcactgaaaaggcatcaattctcaagacttgctatttatatatgaattagagaatgtttgatggggaaaagagactatcaagggcaaatgttgtgaacctgtggagtacatataagtaaactgggacagtgaccatttaagtgactttccttatctagttagtaggggaagcaggcctgagactcaataattcaggctcaaactcagtgcttggtaagaggtgtcactgaagactcatctcattctgactgccattcccaattctgattatatttctgttctctgagctgagggtggattgaggtggcagtcatacctgcccaacttcgtgactcaactgtgactttcacatggatataaaagagggaggggctcggaattctagggttattccaaccagctacatgccagctacactactgtaagcactgagactaaatctgatccaggaaacacttacaaagctactgctccagggccattcctgtggtttggatctctccggatagtagtttaaactctggggatgtgtgcccagacttggaaagccaatgagcttttctgtgagcttgaactatccatactgatgcctccagactgatttgagtctgtatttaaacttggctcaacatataaggggaatccaacaaaaataggcaggttgaaacttttttctcatctgtaatgccattaaatttccttcaaattgctttccttttgcgtttctcccagatttaacatttttagctaagaagaagtaagctagaaaggctgtgggcctctgtgtttgtgcctattttccacttaccttcctactcttatgtgccttcctgtttctctgcctacagtgctctatccctcttggttgttgttgttgttttgctttttccaagactgcatattaaataagaattgggtgttgctgtggttcctgtgttcagcagagcttcatctgcacccatgctgcttaagcgttatggaatctttagttgacaaatacttgaaagccacgaaaggcatcttaaaggaaagaaattaagtagaaattgtgcttaaatattaaggagaaacatattcctggtcactgaaaactgaaaccataccactatcaggagagtgaaataattctaatgccaccattctattagaaaattccgtgtaatatgtcttaattctctcgatgaacatgtctaatcatccatcagagtcagagtgactgttttatcactgagtagattgtacagagtttcttataatttccatatacattgatgaaaaatgggttgtgcatattggtcttcctctgaagtgtctttatgtggtacagggaataaaaccacctggattgtatatcaagagtcaacacatataaatgcagatctcttaaagtaagatatttcatactcttcttagtttattttatttggtggtctgaaatttaaataatctgtaaagaattaagataatgccttttagaacatgatgttcttacttgggagggattcactgtctctgtctcttctacttgaatatcaggctagtgtgtcctttcttagatcatagcccatggttcattcacttatttattaaacacatggttattgggttcctaatatttagtaggcacttttctgaatgtggaaaatatcagaagaaaccacataaattcctgtcctcatggagctaacattctagcagcaggagacagacattaacaagtgaaataataaatgaacatttcagacacaaataaatgctgtagggaatatacaataaacatatataatagagcttgtctgtgatgggataggctgcctttggaggcatgagtgatgagaagtagccagccacagtagtacccggaggaaaagctttcaagtgagagagagtagcctcaaagcaggaagaagcttggtatatttggaaaacagaaagaccaatggtactggagtccaacagacacggtagaggatactgggacacttaagtcagaacagaaggcaggtaccaggccacattggtccttttgaccctgataaggagtttgtcttttatttaacttgcactgcactgtaatttttcaggttgttaaaagcagaatttttttagaatctcataaaagctttcaaagattaattatatcttctaaatccctctagatatatctgtatcttatttgctaatgtgttaaatcacaagagagaaataatttagaaaatcagaaatcaatggtggaaacaagagtagacttttggtaagctgttcttatctaatgctgtaacgtaactcaaactgtgtcatttttttttggctgttggtgagttacatgcataattaattttaatcacttgtagtctctttgtaccccaaaccaagcttttcaaaacaatctaaacagaaaagtacaaattcatgtttgagggaagtagtcaaaaaaaaaattccattctcaatatgaatgggtcctttggctatttccccacagcagatttagttgtaaacaaggtcaggtgccaaacaacaaccaacattaaataacagtgtaacacacattttgcttcttagagacaatggtctaaatctcctgacaatttggtaaatgagcggatccagtttcatgataatcttgaatcatgtatgagattaataagcagtgtacctctttatgcatatattgcttatactaaaatatttaatgcacttttcagatatttatggacttagtgtaatgctctgttgagtttagctttaaatacactttgcagacatttgatttattgtactttcggcatggttcagagctgtttacttttttcctaagcatgccctcaataaacaaaattattatttttttattttgtcatattatgatagttactggacatttccaaaatatcacataatttaggagaaattaatatttttattttataatggggtatttaattattgttgatttttgtttaagcctctttccttgacttctgttttatttttaggattatttttattatgtaaattactttaatgtggaaccatttgatataaggatcttccagacttgcagttactgaaatgttaaaaatatgggacaagcatggttactcatgcctataatcctagcattttgggagtctgaggcaagagttcaagaccagcctaagcaacatagaccccaaatctacaaaataattttttttttaattagccaggtgtgatagtgcatgtctgtagtcctagctattcaggagactgaagtgaaaggattgcttgaaccatagagtttaaggctacagtgagctatgattgtgccactgtactccagcctgcatgacagagccagatcctctctctctctctctctctatatatatatatatgttatatatatatgttatatatatgttatatatatgttatatatatgttatatatatatgttatatatatgttatatatatatgttatatatatgtgttttatatatataaagcaaatcaacaaataattcaaatatattttaaattctgaatagtattcttggaattatatccaaaatatgggctttttaatattgagatattactaagcatcaaatataaattaaaatgtatttcaaaggattaatgaaagagctttaaaaagaatcagaaaagtaattaatttcttctatatagacaaccctgcttgtgctatagaatatcaaatatacagcatattgttctcctctagttgacagtcactagagatataagacataaaactagtattaaaaataatataatttacaacaatattaatggtaaaaaaaaaagtatgtcttataagtgccagcaaattcagaggagggagtgtcattgccatgtgcagaagtgaaacacattatgtcagaagtggcatgagtgtgtgtaggtttggaaaagcacctagataggacaatagcaatatcaaaggcactgaggacaatagcaatagcaaaggcactgaggtgacagtgagcaaagcaaaccagattgcatgtaatagagggttccttttggagaacagttgcctgtgtgggtggtgctggatttgtagatgtccttagtaagagatttggtttcattgtaaggccactggcatcagtgaaggatttttgacctgggaaatggcatgaggaatgtgatatattcagattagcaagaaaaatttggggaaagatagtggcctgcctagaatttctacatatggtgtagcatagagacatcaaactatttagagtgggaaactaaggtacttctttggaaattttggttacagacattttcacatacaattaagaaaatatcaacactaaagaatgggattgtgtgatgctggtggagatgggtgagagttagaagccatgcagaaatgtagtcagtcagtgaataatataggcttctattcgggttatgtcacgtgcatgccaaatatatatattatatatataatatatactatatatacagtatatattatatataatatatacagtatatattatatactatatatacagtatatattatatataaaatatatatatatgtactggccttggaaaataaagcaaaagaacaaagattaatttctatttaattccttctaatttctaggtcttaatggaaatggacttcatgacttcacagattaagttagtaaacagtttttgaaaatcagttatatgtgtgtatatgtatgttaacaaattgtctttcagaagattacaaacacattcttgttagatatttatttctaattttaaaggtttgcattaagacgtattaatatttttatagttaatgtactgtggtagggattggcaagctattttatcaaagggccagacagaaaatttttaggctttgtgggccacgcgtagtctctattacaattactcagctctgctgttgtagcaagaaagcagccacaaacaataagcagttcttatcatgttccaataaaattttattactaaaaacaagtgacagtcccatttgaccttcagactgtattttgtcaacccctggcatatgttgtcatggttgaacatgaatccagaaaatggctttgaaattataaaaaccatactgttaaaagataacaaatacatgaagactatgtgaagacaatagttaatatatttccctttatgaagtcccatggatggaatctttagatttctctcaagtcagagcatgttagatactggagactctttcctaagccactagcttggttttggaatcagtgtttgtgacgttgattttgtctccatttttttcttggcttctagtaatctcagaataaaatcgtgtcccccttcaagtaactgtgtagaatctttagtagacatttcatacactaacattttcatgcatcgttttcttatgatttctctttatcctaattttattgaatctttttattaaaaggtaaaatgtaaatcaaactacattctgtattttcatcagagatctacttttaatgaaagtctgtgaccagaacagtattcacttttcagaaggaaaagatggcatggcctttcaatcatattgtactatcaaattaggacagattgcattgttcttgttcagttttcacaactgaaatcattttctcaaaaataaattataatgtgtgtgtgaatatgctgttggaggacatttgttaaatctgttacccttgcacttaaaaaaaatggggtggatttgttgcttctgaacctttcactgttcgttatcacaaatgtcttttaaacagtttttcaaccctctcaactttagtggtcctggtaggaagatgctaagacccaggtattttgtcttataagtgcatggtcatgaaaatattctgagaattagaatttagatatgtaagcactattctgtctctctccagaatgccacatgaggttttctcattcaaactgaaatctgggacttatagtataactgtgaattttgatttttgttttgttttacatattctcatgtgaaattgtactgttgccttctaatttcgataataggtagatattgtggatacattggaattagaattaaataattggcctaattttaactgtcctattaaatcaatagtgagattgtttgactcttccagaaatgacacgatggacaagagagccccccatgtgaccattagcctgaaaacaaaaacttactaattagctgtgacttgataatgattcttagacataatcaatgggagtgtcaagggaaatggcaatattcttctttaaaaattaagaaaaatagaagaatactgtacaaaaatacataagttagaaagttcttggttgtcagatagttagtggtttgttcccccttatcaggacttgtatttgagataagtcgttcccctgtaatcatcttgcattgtttagagtcacagagaattagaaatgtaacaagttgcatttcaaccagatgtggaacatagacaacaccttgagtgatgagccataggtatagtcagaaccagatttcaacaaatattattgcctaggtgcaattgcaaggaaagtacaataggcatgagactgtactattgttatggtagtgaaatatataaagtatctcgaatattagcaagaggttacattaagctaagttagtcaaaatgaaaagatggtgttgtactttgctaaagtgagttcaattttattttcccatggcaaagaaaaaaattcgtattttattatacatatcagatacttatggaaacagtctgtagataaggatgtggatgtaaatggagtatgaatatttaaccttgagaatattattttcattattttaaaataattatttcagtaaattgcttagggttcctgtattatgcagggttattttttgcattacaaaatatttcaaaaacatgagagcagccactggaaactttgtgatgaattaagtattcatgactttgtatcttgtgattaaaacatagtttattgtgtaaataactccaccgattttattcagcatcctttttctgggaatataattaggaaaagtcattgaacaattgcagttgcctttctcaaaatattatgcaccttcttaaacctgcagagaagattctatatgtttatggagaatctcctctcaccattgagctgaggagccctggtttaggccaaggcacatctggaaaatgcttctccttagaaaagtactattggcttaaacagagtggcaccacttattcatgccatttctggactcatgtcagcatcctcaggatggaatgaaaagtaaccttacgatgacacggctctctggtggtcagatttgctgttacatatcatcttcataaaatctaggtatacatatattcaaaacacagacaatatttcaaatttttggataactacattatattattatttataatataatctaataatagaataaaatagacctcctgttggaaaaatccataccaactctaataaaaatttcattttgctcttaaaaataacatactgatttttattcggttgccatttaactgcataaaaatttttaagttagacatttgaagttatacatgaacagtgtaatgcctcctcattgatggtatataaataaagtttcttctctaattccgaggttggagagaataaaatggagaacaaagaggggtatcatatggtgattgctttgtataactccagtttgactgagtgctgttatttctgtgtacccacattgctgctctgttttgtcatttataagattatacatttgattacctaattccatgactacatgtgattgctaaggtccacatttattaatacctatacttctttgaacaagatgcctaatatgtatgtgtgtataaatgtgtacatatatataatttacaaaggacaactttgcatagactcataaaggaagtactgaaaaaaaatctaagttgaaactaaactatgactttcttggcccttgtttcagtatttttaaggtgaggataattaccaaagatctcttgagttttttgttttgttttatttttgcttcacatctaggaatctggaagtcaaattaaagctatcttttagagcaaagacttattgtttctcaggaagtgagagagagtgaacaaaatatatgccacaattgtagctccatagaaaaaggcaatgtcaacagttttaccctacataagagatgcatatcacttattggtcacattagccatttgagaaccgttagaaagtaagcaactgtcaccctttataaaattgtataaagtttatacaattttaagtcgatgttatgttatcccagtgcttggtactgggatatacaacatgaatagatatagacaaagcactgaatttatctggaggagaatgtaaataaaataacatcttactgacccctatttattttatggttttattgtccacacaataactttaaaaaatcatgataagttacaaactgttctattacactgtgtttagatttatcactctatatcattttataggccacataatttttatggaatagttcactttttaaatatttatccttgaaacattcactaatttcagttttgaagttgtgaacaagacaccatagtcactacataatttttgtttccttgtttgtacagtatttgcaatatttcattctcttattcaccatgatatcccagttgtgtctatgaagggaatggtcaataagtatttttgagtaaatcaatgaatagttttagagacacaagcttagaatcccaaaaggtttaacaaaacttatttcatcctataccaaaaaggaaatggtgagtacttttggagaaaacaagatttgaaagaatcaacactatctgtttctcttaaaaagaaaaagaaacctcattcatttgtctaaaatatccaatttttatctttgacacagaaattcttataacaccgccctcttattgagtccttgagaaagtcatttgaccctctgggccttagttttctaataaaataaggggataaatttgtctccaagactgcttgttttatggttaattggaagagcattgcattaattcacacttttacacaaatcagtcatcttagctacctgtttgctcaaaaaagactgcaatagttggaatgctggacaggtaagttttttttgtttgttttaattagggaaatctgaatgtcataaaggaaggttggaattataaggcacctttcagaggaaacaaatctatccacagtgaacacttactttatattcagcaagtgtttattaagaaccagttatgagtttcctactgtgatgagccatgttagcagtacaaagtaaaagacaatcccacatccttgccctcctgaagcctgttacccagttgaagtcagccacctcacatccttttggcaactaaacagactataaataagtgcttatcatatcactaatttacatttttaaaagtctttgggggaggaaacatacatgtgatacacttaaataagagcccagtcataattatagttgtgtgctaaaatcatcatttatggtcatgtataaaaatgatgattctaatgcataaccatgtaaataatgatacaagtaatcagagctgttggaaagatgagactgagacaaagttttgggaaaagacagatacaactttacattctttgtagattatattcacccttcctgtatctggtgtggatttttaaaagaataaaaaatcttcttgaaaaaaataatttgcaatagaaaggcaacaaggttgtttttcttcactaatgtacataataccacgttttatttctttgggcagttaagtcttaattcatcaggcgtatggataaaacattactcataaatcctttaaattttttgttatatacagatgatctaccaatgtctatttaaattctctgagaatgtcttccacttcaaatgtaaatcctttggaggacatgatgctttggaaaagaagggaaaaaggaggtatccccaaaggatttattgtactgcttttcgaagtggaggccagctgtttttggacctagaattaaaatgtaaattatcaaagggaaataatgagagccattccttttaaacaatgcccagtgcaatcagagtaagaaaaggatttagggagatttccttctatgcacaagtcacgaatgatgaagtgaaaggctgggagggaagtgatttgcaaggaactaagtgaacacaacccactgattgtctaggacacttagaagttgaattaatcgaggaacaggccttcagttctgctgggcctgaatccaaatcacaagataactgtgcatggaacttaggaagttactacattagtactatagcaggactgtaaatggaactacagtgccggcatgagttgcatttcaattcatgtggtttttgaatcaaaacagaggtcttttagcacaatgtagtcagtcagtgccacatgggaacaaaacagaaagattatacatgtttcctcaggattgtctatattaattattggacaaacacccataaaagcttttaaatttgaggattttcacaaataaattagtttttattatgtttttctacaaatgtaagtgcttcagaaaggcccagatgttctaaccagggctacatacatagagtatactcatttaactatttctattaagtcctaatatttaatgtcaatcagatgtcctagtatgtgatgaggaaataaaatgttgatgaggaaaggaaaaagtgtagatatattgatttgtaattggtttttacacaagtaaaccactaagttgagggagcaaaagaactttaacctcaaaaaattggggggtctaggggcccccaagacattgatcaatgattttgcctttttgtatgggttggtgaacaatttctgtagtgtccaaatgactaaagatcagattgcagttaatgattgaaatagtaagagattttattagcaagtaaatgtttaattatcagcttaaattttggcattatctcctcatcctctacctccagtattttattaaggtccctgactcttctttctgtttacactttcactggatgatcttttccattgtccgatatttaacaaccatttgtattctgactacttcctaatctgtatctccagtttgggaatcttccctgagagtcaggctcatatatccaactgcctgccaggtggcttcactggtgttctgcaggcacttgaaactcaacatgttcataatgaaacttatttcaatatccacccttacattcctcttagagtccccattttaggtcatggaactattccaagtcagaaatgaaaaagtcatcctagactcctaaatatatatttctttcaaatttttctccttttcatctctactgtcactgaatttgtttttcacctttcgtctgaaatatagcatttgatttccttgcctccaaacttttcccattaaattcgctatttatatgagccagagtgattgatctttcttatctgcatatttaaccaaatcactcctctgtttaaaatccttcctccagtattaatatagcatataaaaccatgcaaatctggaagcatgctatctcttcaatcttattttcagccactcccttcctgtatttttggcctcagaaataccaatctactatagtctccacacattacttgctctgttcttcccattataggttttttttttttctccttggctagctgcttttaatctttcaaaaccagctcagtttttgtatttctatcccactgtctatttatacttcttgcaggaagtaaccatcatattcatttttgtaaatccagtttctagcagagtgcctggcatatactatgtactgaataattatttgtttaaccaaacaacaatgcaggttcaccgttctgtttagcttttgctagtgattatttgattaaattggtgcttgtctactgcactgtttccctctacagagctaacattagtcaaatgctttagtataacaaatatttttatcatacttcttgatgtatgctaccagtctcttcaacgacccactcccaaagaacacttgttccattattacaccctatcctggataaactaaagactcaacctcagtttcttcacttcggccatggggatagtttatttcccaaagttttgtgagagttaactgatggagagcttatgtgaacatggaagcatggtgtcaggcacacatcattggagttgagtaaatattcagtgaattttcataaaacatgaagactcaacattttctaaaatgtttcaacaccgtcattaggaaataaagatgatgaacagctgctcataggaaagaggtgagctaaaactttaatctaccagaggaggctaccatggggctgtttccacacttgacatcactttggattctttacattcagcaaacctccaagcaaaaccagttttaggaatatattattcaagtactgagaaagaattttaacatttcctttgtataatagttaagtattttgtttcaattttagagattttcataaggtcagcagagatgtctgtatgcttgaaatctatattgttttgctcaggttaatttaatttaatggcaataaatgatttaccaagcacattaaccattaacaccagcaaagtagtcagaagtttaagacatctatctcaagttaatgcaggaaattagaacccccatctttaattctttctcggggactaaaatttgaaatgtatgtgtctctctagttcagtatttcttgtctttgctcaaggattaattatattactcagtctcaatgaataaggaaattaataattcatgcctaaatattacataggtgaacatttttgttgtactaattagtatcttgtaattaaaagtcttgtatgacaagtacgtgagactgtcggctgaaataaccatacattccaattagattcagtaagtcagtatcatttatggggaggaagcctatttgtctaaaattagaacctgggctgggctgatattttgaatcaagatctgaagtgaattttggttgcagtttagtaaaattaagatattttgtcagagggaaaatgaaaattaaagtaaaattcaaacctcattacagtaattactaaaggagtatgtaagttaattgtttaacttgaaatttaattataataactatttttatttttcaaactgagtcatcgttgaaacttagtttgctattcaaccgtgtattctttgaggaaatttgaaagacacttggtttcttgattaaaagttcttatcgggagcaatttttaaaaatagtatatttttaaaattttaaagtactttataaaatctcacactttcaaaaagaaatgtttgattgtcacatataaaaaagcttaagtcaagcttttttgtgatgatgtgttaccatcactactcttacagacatggttttttttgtttgtttgaatgctacattgtttttgcctgattctgtaatcaataaatttcctaaggactatttagttgtaattctcttgaaattaaaaaataatgtatatggatcactcagattttgatttagaatcaattgtgataccttaacacataagtatctaattagctccaaagcggcttccacatttaagtaatattaaaaattgctaataaagcctaatcctattcaaatacttctaatgggcaatagggacactacagttattttgccttcatgctctcaagagagaggtttacgttcacctttatttttgtaaactgactccatgatatgcacaatgtcattctctgctgaggtaatggtgaaagtgaatatcactgaaagcaaaagctacattataattattatgcagaatagattgacaagagtatggtttcagtgtttgggttttcttaaaaccctaaatctatgtggcacaggtttttcagcagagacgttgcaacacatttaaaacatatagccagaaatgtgggtggagacaagaaaagttggtgctcttgtttcttatggaaaagcaaaaatcactcagaacacaagatcctctgggcacgtaactaatctgtattaagagtaagatgtcatttttatgtaacatcttaactacggtgacttattaaatatgatcaagaaaatcatgttctaccaacaggactgaacttgagaataacaatcagaagcattggcaaaccattccaacacccacatcttccaagaaaattactcataatagcaatttgcattgaggtattaggcagcatgttttaataatatgtggactcaaactcaacaagaaaatatagcagctcttttctttttgtccacagaccataaaacataccataacctaaatgaacaaaaagccacatgttttttgacaatcaaaacctaagtacctacacttcctgcccattatagaataccataaaaaaatcaatgatccatcacaagatttatctgcaagaacccaaacaatagatattaaaaagaaaatatttgggttttgggggtagttgtttaaaattgttcaatttaatgccgtaatatggtcataagcttgatgtgttttcagaaaaaaaagtaaaattatttaagaaaagtgtcagttttcatatagtttcttactttttaaaattaatcatatttctattgactagtaaacctcaaacacatacattgctaaatgtggttctggcttatcatacctggtttctttagagtcatatagacctttagttaacaatttgactgtagttatgtccaaagttctgccttggaatttttccttctttgacctagctttaatattacattgtatatttcatcctttccattgaaaaagaaagatcccaagggtagcttgtatttttcaccctccaaaccccgacatcaccaatctcagttctggaaaaaaatagaatcactgcattaaattactttggaaaagttgggtagttaatgactaaaaatgaaacagactgtacattttaaaatgtagaaaattttttatttagaggcttaacctagaactgcctagacatgaatgagccaaggaaaaaaatttatggtaataccaaaagcatttaaaattacattattaaaataggtggagggaaatgaggttccagctgacttttctccccaccccattttgaataagtacatcttgttttctcaaatcacgggaggttttctttaaattttaattgtgaaaccaataatagtaggacggtgtaaagtagaaggctgcttgagagaaagaatcctactgctgtgtttaaatagagtacctttggccctctattgagatttacttgactcatccaagttcaaaattaaagagtggtattagttttccaaaacttcagaggtttgacagtgtcacttcaatagcagatattttctcagatactacttacctaggtaatgtaggtacttcaagattacctaggacctctaaggccaacctttttttctggcaaagctgcagcttgccacaacccacatcttgatttttctttctggagctaatatataagtagataactaaaagcagtaaagcagtagagtaactccttcttcttccagacagaagttctacatggacatgaaattgtggccttctttggtgcctggactaaaacatcctttttgttcagacccaagtgacatttcattaaattgatcatgaactttctatttgataaaaatgtggctttttagtggctcacaagtctgcagacttgattttaggaaagaggccactttcacagaactaccaaatattatcctaccttgaactgctgcccttttgctagccatatcttctaaactacctgttgtggatcatattggtctgtttgggctcagactttcacctttaaggttttgctagggataaaatgtaatatgttatataaccccaggctactgaaatctcctttgctagcatcttggtagcaactctctcattcatatggagaaattcttactaaaaatttgagtagccagcaaaagaaacgatagcattttgtttagaggatcttaagggacagtctcacatgctgatggagagggtagtcatgatgagggtatcaattcttgatactatcctcagtgatgttgctaaccccaaggatcccttagcagatcattattcaagccagtgtcaggttgtttcccaattctctaagtttgagacctgtactatcagtacttccaaataagagactatcagttatgtcctagttactcagagaatagtggaagataactccatgccctagctaaaagagacacaacaaggactgcaaagttcagtagagggctcaccagctctattataagtggttaactcataacttaaaattctgcttttaaagcagcccttcccaaagtatggtccctggactaagagtatcggcctcacttgaaaacgtgttagaaatgtaaattctacttcatatttactatgtttagcaagctgtctggtgattcagatgcacacaaaagttttgaaagcacggccttaatgtgcagtatcatccttcaccatgtaatatacaacaagtagaagaaaaatctactgtcctacaacagcattgctccagggtaattcaatgaggtattgaacctgaaagatgatccaaataaagaggtctattgttgaaatttgggcaacatgtataaatatgtaaaacataaaattgctctcatataatcacttgaggttgggaggtaggtagctgttataaccatgaaaagaccatttcagtagtttttcccctcctgttgaccctaaagctggcagccaatcttgcgtgctccccaaaccagaattattaataattaactgcttcccaaggattaacagaacaacatacctggactacatactaggactaaagagtcttcacttggttgtgttaatttcttgtagctgccataagaaattatcacaaacttggtgctttaaaacaatagaaatgtattctcttacagttctggaggccagggctctgaaattaaggtattggcaggatggtggtccctatagaggttccagggaagatcccattccttgcctcttctaatttctattagctgttgatgcttcttggtttgtggctacatcactccaatctttgcctcctttttcacatggacttctcttttgtctctcaaatctcctgtgtgtgtctcttataaaaggttacttgtcactgggtttcaggcccatcagatccagggtctctacatctcaagatctttaatttatacctataaaaaacctttttccaaataaggtaacgttcatgggttctgggaattaaagcatggacatatcttttggggggccaccatttaaccaccataccatgtggtagccacctgcatacttatggtacttatggccacagtttttggactagagagatatgggggactctgtaactaaagcctgcttttataatgtcattgttagagtcccataactaaccagggtaagtcttgtacgtgcttccattaggtcttccctgacttcgcacatgatttttttctaggcattagaatacggagcttccaagttcagcaccttggtctaaagaggcaaaggaagactcaaccattaggttatacattccacagtcttatttagcactgtatcacctagcacactggctggaccatagtaggtgcttagcactttttttaaaaaattaaagaagaaacaatagaatcaaaaaattttttcaggcccaacagacgcaggcagttagggaaagaacaaactgtcacgctccttattccagaactacaaaaatacttgagagggactgcttaagaaaactggatgtttagagaatgcgtttccctctccttccatgtccatagtctataccaattatctcaaaaccttttcatgacatacctattgctaaaacagtattgaacatactgtctaaaatgcatagtaatttattatacttttaatagttatgtagttcagaacttgttatatatatataaaatatagaaattgaaattaaaaagagcaaattaagcataaaataaagaataatttcaaatatcttgcaaatcacagtggcttaatatctcaaagaaaaatgtaatttgagtgagtttcatcattaatgatattggatataaagctatattgcaagtagtcttgatgatttccagtttctttgtctgacttctcatcagatctgaataggctttcattgtgtatgtctgaaaagattttgtattgaaggttagtgacactttttattgctgtgtgttgcaggagtatacttgtattatcagtattatcttccatttgttctttatgcatagggaattttttaagtcacttatcttttttattttcttttattctattttattttatttatttgagacaaagtttcactcttgtagcccaggctagagtgcagtggcgcaatctcatgtcactgcaacctccgcctcccaggttcaagtgattctcctgcctcagtctcccgagtagctgggactacagacatgtaccaccacggccagcaaatttttgtatttttagtagagatggggtttcaccatgttgcccaggctggtcttgaactcccgacctcaagtaatccacctgcctcggcctcccaaagtgctgggattataggtgtgagccaccgtgcacagccaacttacctttttttaacagattattaaacctcacatccactggccaaggcacacataaactgtcacacatgtaataagccaagagcaatgaacaagaagaaccttttcttactccctttattaagagccatccagtcatcgcttggcctcagtaacaagtggcttttgacttataggccaagtgaagtctcccatgtcaatttacagattagtaacatttcatttcagttagtcttagggaagaatcataaatataatttctaatatctacttcctacacttcagtataaatcacatatttttactgcatcacttagtacttgaatctaaaactcttcattatttgcttttgttcaagtatatttatatgctcctcagaatgtctgtaatgaagataggggtaatgtcttacacttcttcagtatcttctatatcatccaagagtatcttgtaaaaagttaatgctcacaaatactatgtgattaaggactgtagctcattggaaagtctgacttctctatgacttttttgattcattacatatatttaataaatcagagaaaaatagaaatcacctcagtgtagcttattaaaatgggcagtatagtatataatatcagaaaaatgaatgagattagaaactggaagctactgcagaattgtaattattagaattatataattattagaatttctaattctataatcattagatttctaagttatgaaataattttttttcccaagccattagcaagtttgagttttgttccttatttcttctgctgggtatgtaaagacaatatctgctggcctggtaacctgaagaatgtaatccaaatccacatacattgaatctgaacaattgagttatttatcctctgatactgatataagatacacctagatacagaaggttctataacatgaagttggactatgtttagggaaaaaaatgtataaaagataatcttcatttgctcatcacactcatccactctccacctttctctaccctggtgagggggtgagtgtgaccctaggcgtctgcccatcaggctgctgctcctctggcttcctgttggattcagacaatggggagcaagaataggtgatcagcaggtgagaaaggagcaaggccagctctttatttcccccttccctccatgccctgctgctaagattcccacagtgtctgtgcctcccaggtaagtagttcaggccccctttcctggcagtagctgtggtggggtctgtttacactgttccctccccttgctcccatggctctgaggtggtaacagttttctacttttctagccctggctgttgcaacatccctccttggtttccgtaaccttatccgtagctctttatgagagatcccttcatcaaaagcccacttttctaattggagcctgacacatacacatactaaacagggctttagtgtttaatgcagacattcagcaaacttgctgctgggtgtatgtaggcacagctgtaggaggctaaaaatagctctgtctgcaacattgttttttcttttgaaattctaagctccattttgggggactcagtaaggactttatctttaggtgccagcttttctcttgcaacctaatcctctctctactctcacaaagaacctgataatagtcaccagttacccttgttactgaccacacaatattttaaaatcgatgaattttagagaggcatacctcagcctagaactctgtttttcatctttctctcttttcaataaaaagattgtattgattgttaatgcaattttagaaagcaccaagttcatgtagaactaattgaggacccaaaagaacaccttgaaatcaaaataggctgtttgcaagtctagccttgagaataaaccatatcatttctttgaggttaggagtgtgaaagggtatgaagtgacagtctaggtatttttctcctttagagatggatctgtgatctctacaagtagacagagtaggggagagggttgacctatatgcaaatactaaagacctatttctaggagctatttggtttcagcagcttcttcaaggatgtaaaacccactttcatcctatcccctggcaggtccttctctctagaaaggcattctgtcaggaactctcctctttcctattgagcatagatcagtttcctttcatctaaacacctctgaatacattttgcattttttcacatacctagaaaaaaatcatggttagtacccctttatggtatcctgaggcatatcatatccctaggcatcccattttctttttgcctctgataatgacagggcaaacaaagtgcatctttcgaatgaaacttcatcagttggattagaataaaaccatattaaaggatggatccacattttagaattctggatagcaatatatttggtacttctagcatacagtcctatctcttataatgcttctcttcccttcagtttttagcctgcatacatacctcagtaccagccaacggttctttatgcaacctgaaacatgcagagaagtagaggggactgtttttaatatcttaccttaactcctttgctgcaatcttatagcattcttttatttaacaatcaaaaggatacacttagttggtcacagttgtctctataacactattgatcttttatatatataaataatttatacctatccatttttttcttcttcattgtaaaagaaattggaaatatttagctttaatcttttgtttttgctcaaagttcttatatttcaatcctgcaattttatttctttctgtttgtgttttctcctgcatgtctatattttaagtgtaggatagccaaaaagtgatttctgtggcttatacgaaaacacaattcatatggtgtgccttatggtctttgtgattaataccctgttattccatctcagaatgacaaaataagtgtagcgatgttgttgttccttcgatgagctatctgaacccctggatattctctgctttaatgatgcatgatcagccattatctatctcgtattttctttgtttaagaaattaatgacaaactggccatgatagtaacggtttggcattttgcttggcaaattcattcctgcataagttgaatttcatgtgttaaaaagaaagtttttttccccacttaagaaataaaatatcagattctacccacttaatatcaaagtactttaagattggaatgtacagttttaatacataacaatgcaacataacgacttaaaagggctggaagaggactaggattacatgtatatatacctatgactgttactgtttatattttttcctaaaaattaaagcctaaatcatctcaaacatttatatgtgcccattttatccttccaaataaaaagattacataatattctgttagtaactaaaattcttgtttaaaattttttttatcaataaattatttttttaaaccaaaggattccctattctttctttacatagatggggtgtcatgtcaggaaaagtgatatttctcacatgagtcactatcttaatgtggacatgattagggtacacagatggcactatatgataacctttctactggactaaaaaaaatagaggacaggccgggtgtcgtggctcacgcctgtaatcccagaactttgggaggcccagacgggtggatcacaaggtcaggagatcaagaccaacctggctaacacagtgaaaccccatctctactaaaaatacaaaaaattagccaggcgtggtggcgggcgcctgtagtcccagctactccggaggctgaggcaggagaatggtgtgaacctgggaggcggagcttgcagtgagcctagatcgcgctctgcactccatcccgggcaacagagcgagactctgtctcaaaaaaaaaaaaaaaaaaaaaaaaaaagtagaggacaaattttaatgcaattagctcagcccaggagagagtgaaaaagctcaattctaaaataagaaaaaaggaatcattcttctttctggtgtaaggcaggattgttcaaccacagctaatatgttaggaaatcatcaatatattcactgaatactgaatatataaagagagagatggagtctcgctctgtcacccaggctggagtgcagtggcacgatctctgctcattgcaacctctgcctcccgagttcaagcaattctccctccctcagcctcccgagtagctgggattagaggcacccaccaccatgcccggctagtttttgtattttttagtagagatagggtttcaccatgttggccaggctggtcatgaactcctgacctcaagtgatccatccaccttggcctctcaaagtgctgggattacaggcatgagccactgcacctgtcctaaatactgaatatcttagtaaattccactgcatagcaaactaaaagagtcttttaaaatatagaatacataatcatatgtagttgcattattatgtaaatatatgataataacaaatatttgtgtactagactaagggttaaacaggtgcattgcactcattgtgtgtgtgtgtgtaatcatttactctgtcttagtcaactttggctgctgtatcaaaataccatagattgtgtgtcttaaacagcagacatttatttctcacagttctggaggctagacagtccaataacaaggtgccagaagattcagttcctggtaaagactgtcttcctggactgtagacagccatcttcttgctgtgtccccacatggtggagaaagggggaaagcaagctctctcgtctcttcttatgagggcactaatcacatcatgaggacctcaccctgattaacctcatctaaacccagttacctccgaaaggccccatctccaaataccatcacattggaggttaggtctccaacatataaaccttgtggggacataatttagtccttaatgttttccttatacaatcttattaagtaggtaccattatcaaccttactttacaaatgaagaaactgacatgaagagatgatagataatctgtccaaggtcacacagatagtaagtaataaagttagaattttattttttgatcttattttgtctttatgaacaatcacattttaaaggcacattaaaatataatagattaacaagtagttttatctctgaaattgctccagctctgtgctgttattgtcaaagctggcctctactcatgataaccagagtgaaaggtgaaagtgtactattgtttcatatttatcatcccttgtaatgatcctcaaatgttcaaaatatggatgcatctttaggaagatttcctgacacacttcaaaaattattagcatgaattacttgtataaaatgcagagcattaataaaaaacacggcttcatgttcttaatatatgtagagctggatgactctgatatataaataaattttttaaggtttctagtaatgttttaaaaagccaccttgtaatcctggtcctgaggaatggatgtcttgcttgtggtgatttagaataactggattctcattcttaaggtattaattattcacttggctctacaccttactgactgacccacattatccttgcgagtactagcattctactactactaccaccattactgtgaatggctttttggattttctaagtgccaggcatattattaaacatgatatctacactatttcctgtaatcctcagaatgatcttgttaggtcaatgtaccccagttttactgacaactccttaggactcaaggtcaaaacctctgcatctttgatctaaagcagccataaaaagaagtgactatcactcatactccctggcatcttgtcacacttgtgcctttgagtaattttttaaatgaaccttatcatgtggtaaggtacatccgaggtgctaaatggtgaatcctgtcactttcaggaatcggaaaggatttataagatcttccagtgcatccttaggaattataatctcaaaccaagaagattggttttctgcttatagtattaaaaatatcaggtctgggagggactttagatgtcactgttctaaaccttcattttactaatggggaaactgaggcccagtgaatgaaggagccagtttaaggtaatgtaccacatttgtggtataatgaagaaccatcattttactactcaggcctcttgctctgaagcagtgtgggtcctagtgaatctatgttagatatgagaaagaatggtggaagcacaaaggctgcaaactgagtctgtatctgtgattagggaaagcctgcaaagataccaagacatacagaccatgtgggagggaggaagaaaagagccaatgacaaactaagagtagctctactttctctgttccatttattgcacttgtccttgatccctcaaagaggaagtgttgtggtcattgttgttcactgtgatcacatgttaacaagtagaggccacaagttacctgtttacttccttaggtcagacattagcctatgaaacagtgtgccttcttcatatgaaacacttagctcacaacagcatgttataaactgcaaactccatgtaaatcacattcaagaattgggagttgggataaagaacaatcttcatctttgtgtcatggtctttgttatagataaattgtcatcattataggaatcttagggaagtaaattggtggcccacttcttccaacacacacacatgtacacacacaaacacatgcacagatcaaaagaaattaggtggatcactttaaggagaaccccattccacttataggtaataattttaatcacagttaatatttagttagtgttttactgtataaaatgtgtttcaataacattatctcattcaacattacaacctgttttgaggtggtagttatttctttcttggttttacagatgaagatattaagaatcgtgaagggcgtgaatggcttggctatggcagctacccagatgagcttttgcatagatattggctcatcttttctgcactttcactgggtctggcaaaatcttcctaaattacccaccacctagtctggagaggtacttgttgacctatgtatcttatctggggagcagtgaaccagctgctagaaaatgactgcatacatgcacaagtgcatcctacgttattgctcatttttggaagcaggaatgatacagtacaaaaatggaggcctaaggaagtttattcagtttagattttttgtgtgaatgggatgctttggtatagtagaaagaatattcaaccggtggtcatataatgaagctctgaactgcaactcttatgagttctgtgacctgaacatgtagcttattctctctgagcatcaaattcctcatccattaaaagaggacagggatatccaccatatgtacttcataggattgttggaatgactaaactctatgcatcacatgaaagttctctgaaaatgggaggatacatgagaagcgttctagagatagggacatggagatgggggattatagcccaggttgtgtcctattagtgtagatacctgagtttcattgccatctttgcctttccttcttaagttaggatgatccaaagtgaaccacaaaccatgggccacagtatgctactgcccttctcaaccactcaaataaattgcagctataaaggaagatatctccacagtgtgtttttatcttgattttgttgggactgccaacttttttttgttaaattttaaaaggctgcactatgtttccagtattgattattagtgtgtcctgagcattgggataatacaaataagtaggtaatttttttttttactttggcagaactctctgctgctaaaatgccagaaatcccatttaataaagtagaatcattgtaaaaggcttggctatactcccagaacaggagattccccagtgagaaaccacctgttagtaaagtcttcattacactgtttggagtcacagaagaatgtaaattatccagagcaggcaacacagagggtctggagggaaattacctcctccctaacaactcaaagactgtatagttataccactattatatgagtggatgcattccaactataccctctgtaactaaaactttttaaaaaggaactgttctagggttagggacatggaggtagaaataatatcgagagcaaaggaaacaggaaaactgagattaagattaacaccaaccaaaatatggtccatgcaaagtaattaagtaactagaactcattcacagtaagaggtcaggctgcctattgagagatagttgagactgcctaaaggggatggtcactgtatttgaataataaagcaactgggagtttagggaaagtgaagatattttggattttctccagcatctgtgttgtttacctctaatcacaataataattcatatgggtagagctcagtatttccaaacctgaatcacacaggctgcctcctgcccatcagaagtcccatagaggtgtttgaggcatacgatgctccctccacctgcctgagaagcagtgaaggatactggttaagagcatatggtctagagtaactttgtgtaagtgctctaagctctctataccttagtcttttcatatgtcaagcagagatgatacttatatgtagcttatagggctgttggggagatcgcatgatttataatacatgtaaagtgcttagaaaggtaatgttatctgacaaataatcattgagcaaagttgaatgataaggaaatatagatcaagctattgctatttgtgaaattcattttacctctgtaagacattttaattttttccctagtattctggccctttcatgcccagtatatatagtgtactaattaagagaatgagttatgtagtccaactgcttgtgtttaaattatggctccactctttattagctctcatcttgggtaaattatttaacatctcatgcctctgttttctcatctgtaaaatggagataatgccattcatatagttttgaggttgaatagtgagtcagtgaagtgagacatggaaagccctagaacagtgcctggcacatcttaagtgcttgtccaatgctagctgtcatcatcattattattattttcctctggaacttactttttctccataactgggaccactagatacccccttaaaatctacccctttcctaatattcaagacgaagcctggcctaaagttaaagatccaggaaaacaactctaagtctgtctcagcagtgcatcatcccattctgccctccaggcagattcggatcttggtgtctagctctcatacatgggtttctactgtaattcttttgtcctgatttctattctagcactctatgagactccctggactctcttacatctgaggtgcttttctactgccttagagaacaatcacatcactgaggttcattggtaaatctctctgatgtgcactgcctaccaggccaccatgcatttttttgattagtagcagtttgggacttgcaggccctagtcttcatgcctgcaggactgtgctggatgtcctgtaggtcttggacccatcatgtttgactattccatggagcttctattcttagtacttgaaaccctctcaggcccatggagagtctctccaactcttagcccctttccttgtctttcttgcacatcagccacaacctctgatgagcaaataaggcctgttgctagattaactgatattctatgagtccaacctcctttacaaaacaaatacttggagattcagctaagtggggtaaaatttttcaactcagcacataaattattctgtttagaaattataattcagtttttacaaacctgttttaatttgtgagtacaaatgtgatatttcactgtgtgtgtgcatgtgtgcatagtttcctcaataaattctggaattatcgttttcatgaagtaagaagtatataaaatagatgaagaaattggccatcgtaatgtatgaagattactaatatctgactaaccgtgtttacaatgacggtctatgtcagctatgcctattcagaggaaaacaacataggtggttttaaaaagaacaaactggttctttgggacgtggatattggtttcataaggtagacactggccctagaaaatcactgcagtgcaataaatttagtgactcaggtgccttagagttgaaagagaaaaaaattcccttggtaactgggatatgggggaactaggagaaatgatcttccctttccctttccctttcctttccttttctttccttccttcccttctctttcccttctctccttttccttccttccttccttccttctttccttcctctttatttttttctctttcttttcactctcttttttcatcttttaactaatttataacaaattttctctttcttctgtttgtggtaagtagaatcttactttgtgggtaattaaaaaatggaaactttttggttgttgtttttttgagacagagtctcactgtgtctcccaggccagagtacagtggcataatcttggctcactgcaacctctgcctcccgggttcaagtgattctcctgcctcagcctcccgagtagctgggattacaggcacgcaccaccacacccagctaatttttgtatttcttgtagagacaggttttcaccatgttggccaggctgctcttgaactcctggcctcaagtgatccacctacctcagcctcccaaagtgctgggattatagtagtgagccactgtgcccggccaaaaaatggaaactttgaagatataaacttgtttcactggaaagtaaaaataaacaaacaacccattaaatactccagaaaacgtgattattaagtaaacttaattattactaccagaaaactattcacaatggttcaaattaaaaataaagcatttgtttaaaaatctgtgctctccaaaatgaactacatgactacttacatttgagttaaataaatgtaataaaatttgaaatttagttactcagttgcactgccctcatttcaagtgctccagagacacatggggctagtggcaaccatgccagacagtatggattcacataagtttatattggatcattgcagaaagtttgactgcatagcatggctttaaataattcccctgtttaaaattcgtagtttaatagattttttttttttcgagacggagttttgctcttattgcccagactgcagtgcaatggcacaatctcggctcactgcaacctctgtctctcaggttcaagctattctcctgcctcagcctcctgagtagctgggagcatgtgccaccatgtctggctaatttttgtgttttcagtggagacggggtttctccatgttggtcaggctggtcttgaactcccaacctcaggtgatccgccccctgggcctcccaaagtgctgggatgacaggtgtgagccactgcacctggccttaatagattcttaattaattgtttttattgtttgtttctttggtctctaatcttctagtatttcagcctcttcttttgccactcttcaggtctgttttattctcattcatctcagtactcttacacatgttattcctctgaatttccctttttcttctgatttttttctaatccatggaatttaatccagatataatctggcagaaaaccttccctggcctttactctctggtttagatgcctttagcatctaaggggcccaatagtacctcatgcttattttatgagtcatcacacttatcaaaactgtattttaattcctctcctaccttgagctgctttataaaaaatcctggtaaaatatatgaatgttaattcaattcaatttttgacaactatgaaacgttttgttctagttttcattttgagaataagtgttgtgagaaaaggggaaactggtgtttggatgtagaaaagagaaataaaatagatggcagatggttggacttttcaattagaccttatcgggcaagatcagaaaaaataaaggaggtaaaaacaggcttcagaactgcactccagtggtatccttgaaaagtgagccacgtgtaaaaaggacagtgactttgtcatggatttaacacaagaagagttaatgccatggaactaaaaatattggaccagaggtttgaaaaatacttagttattccaattaggttatttataggcaaccttttcaggcatgtacactactttgtatctctgagagctcagtagaacctaggagctgggatccaagagacaaaaagaaagtcagtctctagtcatgaaactgaaaaccactgaccaattaggagaccgcaccatgctcttactttggatgttctcttccacaaatcttttaccaatttttgctattatggtagcaataattaactattaaactaatctaattagctattaaactagtctaattatgactagtttgagatgcaaaggatataattggtttagtatttggttagagttatgtctttgatgcttgggtttagtaaataaatatattgcaaagacatcatttaaattctaacattctccacttagttttaagattttccattgtaaataatcttataatagaggcttttgggagcccaatctctttaaatgaaaagagatttttctgtaattatctgtttgtatgcctgctcttctgtcaactcccagcataatgcacacacacacacacgtgcacacaaatacgtgcacacacacatgcacgagtaacttgaagatgtcttcatcttcaagacacacatgagtgtgtcttttatttatggatcctcagaatctatctcatgtggttattgataaatgttgagatgagaaaaggcaggaagagatggaggaagaaatggcaaaaattgtttctatactgagtcttatagtgtcattctacaattataagctggctctaatcacctcatatttattcttaataatatggtcttttaaaatttgttctgataagtcatgctatttctaatttgttttatttcatacaaaataataaaagtcaacttcttaccatttcttaacttgtctcatgaaagtgttcctttggagaagtgtccctgtcgtgctttctggtctgcttttaggtaaggtctgacttctgccactagaggcctgagaatgtttttcttctttttttggcctctctctggggaggaagcagctttcaacatattctttccttgtgaatttgtaaaagttgaaatcaaggcatgcttattagttagtaattataattcttatatataccaatgagatataatcataatacatttacaaagagaaatcataaaaatgtatgtactgaaaatcagtgcccatatttcacatatgaggaaactggaatctaacctaaactgcccaggataaaagggtaaaacctgagttataacattttaactgttgctaaaagaaatcattgaaataatctatggtagttgtctcgtcccactttcttttttatctttgtagatgcgtctttattgaaagtttgaatgttggtaaaatactattatttgcctgagtcaaaggagagactgtagattcagtgaagtaaagaaaattgttggtgtagggattgccttttaaactagctctcagtcgctagatttagagtggtttatatagtttttgacatacagacatctccctcactctgagacatctaattataaacatgacaaatattacaggtgttcaaatcacagagtttaggaatgactaatggatgactggggaaaattagctgtattactgtattatttttcttcatgaacaggtctgtctacagtaacaagtccaaaatttgagactgtgctctatgccatcccaaattctttgaatgattgaaatggttcactaaaatagatgattatatctcagtataaagaaaaaattagcttgtcccttgttgacatagcttcaatgttagtctttttttctgaggaattagcacaggtacttcgattgaaaataatatagtttatattaggaactcacaaccatctatttccaactcttgaattagtttggtaaaaatctctacatgtgattatttaaagtaatgtcaatgaagtaatttagatttattcaaattatactacttaatgaagaataaattattgcagtcaggcccatttttgtaacattattaggcaatgtttgctgtttggtgtgggagagtttgaggacgcttgaaggtgacattgtttctgttttcctgaaagaatgaagctggaaaacagtgatattactctacagatattaaactatacatgattgattgattccagtccagcattcattaattatactgtatttatcagtaacacattaataataaaattgcttaggttagaaaaaaatcaacttctactaaaggttacaaagaatggattttaaaaataactgtttatctagttataaggtcattaaagacaactaatatagttttgaaaatacaatgacattaattaaaattgcctgtgttcccccaaaactgaaatcatcttgtaacatctttcttaaaaaagtgttctttttattgttagtgtaattatactgctgtgtatgtgtacatgtatatatgtatactcacacatccagataattataattgtgtgtgtaaatatatactgttctgtatctatcccacccttctcatgtaatatcataagctttcttctcaatgctgcacgcatcatatcacaggaatagactatgaccattcccccagtgttgggcattttagtttttttccaaaggtcgtgaattaataaaatcttagagctggaaggagacttagggaagatttaatccagtcccttttcttttataattagatttttatggttaggactaaggtctaaaaaagttaattgactgagagattattttatttaggaaaataatataaatgacatagttccagaaatacttttgtctaaaaaaaagtgaaagaaaaataaactaaatcagtcaaggcacattcaaaatagaataaaaaatgtgcattagtaatctatcattggagtgagtaatataacatttgctataaatatttttcacattttaaaaggcaaaataattgcatataacataacttttctagtttctatcattgtaagaggaggacacacaaaatatggtattgcatgaaaactggaaaataaatttctagtctactttctctaaaagttctgagttaatttcatgactgtatagagtgagaacatgttgaaaagcaaacctgggttttaaaattctttccattcagtagtctcagttattacaaagacaataatactttctccattctaggatgtaaccacttggcatttaacttatttttcatttccttatatttgttcactacactacaatttgtagactccataggagtctaaatgataatttggttagcaaacacccttaggtctaaaacacatgttggttcttgagagatttcccttctcctgttctagttgtgcagaggtgtaattttttaaaatagatatatcaatgggctgtacttcattttccaaaagcactgtgatggtgaagccaagcctctgaaagatcaaggcccagatcttcctcaggtttcactttagttaagactgttgcagaaggagtccaaagaatcagaaatgctggaatttgtcctgggccatgaagaatatttccttaccaaatgacccaaagctgtcattgaatgtatgacttcaagtatgatcaaacattgagcgggctggtttgtgttaaagtcccatgagactactaaagaaatggttatttagtccaaagaatcataaactattggtttgtctcagtttcttacagagtaaaatttgagagtaaaatttgattttatcagctattaatgcctacatttgtcacctaagaaaatgggatttctagtattagcttttgattaaaagaccccctacaaataaatgtatacacttgccatattccttctctcaaagtagctctaatccatactgaatactttttctagactgatttttccctaaaatgacatttggaagtagattttgggaagtttcctcacctctctaaggtttggtttccttatctgtaaaaaggactaatagtagtatcttctttatcaggttgttggttaagcaaatgaagtggtcagatcacattaaatgtccaataaatagctacatttatcaaggacctactaggtatcaagtactttacataatcatatcatggcaataatacctacccatttttcacacaaagaaagtagaactttgaatggcaacttaattaagaggtaatggagcaaagatttaagctagcttggtctgagtgattccatgatctaaatgctacatatttctttctccatgaaaacccttaaagatagggaaggcatttgtttcataaatagaagaattgaaaagaacttgtggagtttctctaatgacatggcaaaaagctaagaaaacagcagaagatcaaattcttgccactttcaaaataaaagagctacctggctctcactggatgagagggactgaagacttgaatttctctcttttcccactaacccctctcctgtgttccttactaacatttccagttgcccagtggcattttctcttgagtgtgccactgctacattaagctcagtatgtcccagtcagaactcatcacctcttccacacattctccttcttgccaaattttccttatttttaaggagaacacttcatgcccatgcagccacccagactctaattgacagagcaaaagctttctctcacccccacatttaatttgtacaaattgtgtcacttcttacctttgctatgtcttttttggactttatttccacctcacttattcaggccttctgtcccttattaaattaattgcaacgacctctttcctggggtatttctgttcagtttctacccctgtcattttgtcctacataatataccgccagaagatgctttccaaattccatcttctgtcctatcactctcctgattaatcatttctaacgtctacccaattcttaaaaaaataaatttcagcttccaacaacataccattgaggactacttaaaatatacttttttagatttgtctcttcctactactcccattcatggccctgaatctctgaccagcctggaatgatctcaccatttctcacatactctttctctttacattcttctcatcatccctttgttatgctactctttctctgtattaccattttgattctgttctaccaggtaaaatctcatatatgtattattcctaaagtattttatttctctgcatttctccttggagtaagaattatttactctttcttgtctagactgaagaggcaagataataaagagaataagagcatggactctgcagacagattgccagggctcaatctctcttctccaccacttattagccataagaccatgtgcaatttcttaacatccgtttgcctcagtttctgcatttttaaaatagggacaataatggtacctgtctcataggttggtatgacgattatattaaatataaagcacttggaacaatgcctagctcatatgaagtgctacaagaggttgttacataaaataattaagaattggctgcagcaactggtttatacttaccttatgacagggatcacattttacgtcatattatttgcatgcatatcttacctaagcctgctcactccctcagccctaatttgagaatgagatttttgcttttttttttcattgtatttcccatagtggggtttggcacttggttcttgaaaaattcaactttcatctcggtagttgactagtccattctcaatagaattattctaaaatttgggccagttttatctgatcattaatttttcacatctctcctagtaggctaatttcagtttttagaaaactaaaaagtctcatggaggattttttcagtttagtgtttctttttttttttttttttttttgagacggagtcttgctctgtcacccaggctggagtgcagtggtgcgatctcgctcactgcaagctctgcctcccaggttcatgccattttcctgcctcagcctcccggagtagctgggactacaggcgcccaccaccacgcccggctaattttttgtatttttagtacagacgaggtttcaccatgttagccaggatggtctcaatctcctgacctcatcatccacccgcctcggcctcccaaagtgctgggattacgggcatgagccaccgcgcccggcctcagtttagtgtttctttaagcacacaaagtcttacgttgagtttatcaagagtttgtccctttaacactcagcaacatgagtttcatgattcttatattttttgcaaactgcaccaatagataatgatatggtacctttggaaagagtgttacagattgcatctaattaaaccatatggatatctttgatctgggtatatattacccttacttagtaggtgaggaaacaggaggcagaggcacagggcaaccaagtaatgttgatgggactgctccagtgcctggggccaccaacatgtgggaacatttctctgtggctcttaacttccagcttccaggataacatccaagatgatactatcaggaccacactgtaagtttatgactgagccagaaactgaaccaggtcatgaaatcttactaataagaaccagagagttagaagagatttggggaatcatcttgttcaattttaaatgcgtgaatcctctttaaacagatttatgacctgagcttatttgggccttatttgaattcctccattaggaaactcattatctcttgagtcagcttaccacattttctcattgctagatagagcttcttagtctcaggccataacttgtcttcctgcagttttcactcatttgtgtaagttgttcccttaaactagatacgatatgttccattgtcttccataagatgtttgttcctggttgaaaagacagattccgtgccttccgctgagtcttcttctctgggccaaaatatgcttagttctctaaaacatttctgatgtaatttttttttatattttactttttaaaaacacaaaaattttattttggggggcatactcaagtaagtatatgcacaatacactttttttggttaatgattaatgggctctatcttctttccatctccatcttgttaggaagagaagcaatgatatgctcattccatcctttatcctttcttactctccctctgcacctgctgcagcctcccttcacaaccagtcaacctctctgcctttctgtctctgtctctctcatacacacatccctccatacacccacaggaatgtcagtgccttggttcctactcaggctaagaattacctaagcaagtgtagttcattcttgcagattaggggttataaaaataatttgtctttcagccacacacactaggatttgagttctagcattgccactcactagttatgtttctctaacagaattatttcaacttgatgcacctccattttttcaacctacaaaattgaagttatgattcttgtctcactggccagtattgactgttaagtgaaatagtaaatgtgagagtgtgtggctcacaataaatactcaagaactactggtttctgttctgtaggtctacattctcgacagcccacctaccagttttattatggtttgctgcatcaaacacatatgtttgctttcagaacttagtcatccatatttttttaatatagcaaatcttcaatgttcaaaattagtatagcatgtttgaatttaaacacttgtgattgaaagaagtgaaaatccaaacaatgctttgggcaaggcaaatgctatgcgggagaagatcattagaaacagcttgtcatgtacatgcacagtgccccttggcactgttttaaaagtggttttacatatggcaagggatcttgtatatttatctagccaagcgtattattaacgtgtcttctttagcagtttgaatttgtgctatactgtaattacgcatacatctcccctctcacagacttctcttctgccttacttagaggggaaattaagtaaaaaatatatataaacatatatattatatatataattgtatataattaaatattttttctaccttttcctgtatttttctcctgtaaaataagtgatgtcactgaactgcagtgggtaagggtaaaatctcatcagaaagatgtcttgtctttgtcaccaaaagtttctcaacctcacccgcattaacagccactgcccctggctgttctgtctccatcatagctcccatgcaccatgtactttcaattctgaggtcagctaggggcgcttggtgtggctatactaactcccaagtccagcttctctgcactaatatacctggattccaaaagtaaatactgaaagggaacacctttttgagggcaaaaaccacttgcacattatctttccccattcatcttctctaatgaacacaaacacggtcttgcttttgacaatgacttactgattttcccatatctcctgaacatgcccttcaacttgtcctccatattggagtagactaattttggaaaaatacaaacttatcagtattcatgtccctgtttaaaggtctttagtaacttcccgtttgtcttctggtacaaagacaaatctttctatgactgacaaggttctgcatggtctgactcttgcctgttttcctagtctcacttctaccattctccacattgccacattttacctcaaatacaccatgtttctcttttctaaggcaacatgcattttcttctagttcacattctcacccactctccctctttctggttaattctgactcatcctacacaggaagggaatccttactcaaactccttcaggttcttttgcctcagaatactcacttcaggttttaattatgttaaacctattaatacctgtcttctctactagattgtaagccttttgagaatgggaactgggtctggttttggtcaccaatgatatccccagtacctagcatggtgccttacatgtccttagctattgaattgttaaataaaagtaggtgctgctagggtaagggaggaatattaaatggggtttgaccattaactgttctaaaattgtaggtaaatttggtaaagaaagctattatttcaaaattaatttactaaaagtttttaagaactgtgggaactttttaacctagtacttaaatgatttttctcatgttcccaaccccccacccccggcacttaataaaagaataaagaggaaggaacgtgttctacaaatactttatttatattaattttcttttatttgatatatgttattaccttaaaaatatagttccttgagaatgaagggttaaattaggttttaaaatgccaaataagtagaaattttaatgataaggtcaaatatatgtaaacctggtctctattagtaggaatttctaactttagtaagtcctaacataaggacatgaaaatgagatattgtatttttgctgctgtgttgaaaagataaataaatcaaattttatggttaaaaggagtttcacagccaattttgctattctccccaccaccacttcatcccaatgattttccataagggttaatatgctagatatgttatgaacagctgacaattacatatcatgtaactattgatttttttaataataaattttattttgtatatatgaggtttacaacgtgatgctatgggatacataaaaataaaagatggttacaatagtgaaacagattaacatatctgtcatctcacatagaagttatagatttttaattttcatttggagcccctctgggatgttattactgatggccttcagagcaagtgtgtgtctgggctgttagccaaggatttaagttggtgactaggtttattaaggagaaaatgggtcccttaggattgttcaaggtatatcaacaccaagcttaaaactagagtcaggaagctgttgaaggccaaggtacttggcctgctgcttcatttccaccagagttctgaagggtatagccagccctgggttatgttggagttgtaaagtgacacttaaaagctcatggtcaggtgaatctcaggaaaaacgagaccttgcagtctgctattcgtttccagaagattgaagagcacaattcatcaaagtactgacaaaggcttgagtgttgaaatacctctttgtgaatgaaagaagagaagttaagcactaattaccaaagaccatttgcccccttaaaccttgagggaggaggaaaaaaaacaggattgtgtaacacagagatgagtggttagaactactcaaaaaaaaaattattgccgtcactgaaattgcttagtcattgttttatatccaagaacagtcaactgtgagttggtacaaaagcattatcatatttaatataatgctagcaatgaattagaaggaagttgagagatcttctagtcaagtctgtcttataggaaagaacataagtggattagcaattttcaaacaatgtatagggatttctgattactgttatgtatatatttattggttttacattcttctgattctttcaacatcagaccaacatctttgatggctaggattgcagtctgagctccaggagcaggacgctactccttggtgacttcatacccttcttaaagtatgtcacaaattgtcctccccacatcaactattattgcacttcctgcttagtgttgtgctgtattttggtctggtctgtctcaagtacttactagcattcctggaaccaagtttgttcatccataaatcccacgttttacagtgattgtcaggttattggtggcaaataattatactttggtgagaaaataagtggtaaaaaagtggtctgtgcctttctactcagtgacttttagaggattttactgatgagtagaaatgttgctttccttcattcttcttagtattttaatatagattaattaaataatgaaaatccatttgttaaagagttaaggtcttgagggtgaagagtctacagcaggacctaggaggtagaaggaggtatagtaccctatatatttaaaagtttgcttttgtcacatatgttttcattaagagacctgtacaattttatattatgatttatcacccccaagtgtctaaattttaatttaaaattttatacttaggggtatagaaacagataaagataaaacagagatgtatagttatctactcttacagttttggcctgccaggcaaaaagttacaggaattattaatagagatctctgaagtgtttatgagactagtttgtgatatatttaataaataccttagatatgaagtaactaatgaaaaattagaacttaggaaatagaactaaaattatttatcactgtcttaatagcaccttattaaacaatgactaaatacatatttgtatccttgtattttacagcatatattttaaaaaaattatcacatattacttcttaaggtttcactaggagaaaatgtgattatttctagcttactgtatttatttgccttatgcaatctttgtctatttctgtgtggtttcaccacttaaggatctactccgcagtgctctactcacattccacaaacctgattcatgttgttttctaacattgaaccgatctgaggaggcaaactttagaagtagtactcattaccttagatgctctctatagtggtttaccaaggggagcttgagatatgggcatactgccaggtgttgaaccaaagcaattttggctacaactgatttgtggtttaatctttgtaaatgtacttaactttggtctaagttttaggaagtcactgcaattcaatggagccaaatgtgtaagtgcctaaagacaatgactttactgcatgtgttttgtcagttggatttttttttcttagatagtgaaagttatgagtcctttgtataatttatgttacagcatgataggaaggcagttatatcgctgttaaaataattatttattgcttattccaccagcccaggaacaatgcacagtctataaaagcagattctcaatgctggtttctgacaaatagtattccattacattctaatataatagtatggaccattatattccataatctcctgctttgaagatcagtattgttataagaaagaaagagaggggagaagtatattatatatgagtgtgtatgtgtatgtattacaaaaattaactgttcgtataagtaacaaagtataactttattacaccacaaatactaggacaaatgggtgctacttaaagctcgaaatgggtgattttcaggcaaataaaataaaaccgtattttactacacagtgagtaaaatacatggagattgttactatatgcatacatatatgcaaacaatttaaatctataaataggcatgaggaaaacatatatatttttctcaattcaacaatattatttctgaatccaatttggtcaggatttatcttctccctcctgccagagataatttcaaatatctttttcactttttgcaagtaatgggttttcactctagtattattcttgattgggtgaaagcatttttttcctacctaataattttctatgtgtatgaagaggaatgagttttagctccatttcttgtcttaatcctgcagtctggaaaattgatttatagttagatatctttaaacacaatctgttacagtaaagtaatttgctcccgtcatgaagtttacataaaaatggtaacatcctactgtgtgtttatacacgtacacaaatcacaagtcagtgaatgtaaaaccatcttctgatcagttcttaaaaatgcatacttgtaagattttgtctttactcatggtaaaaatatataaactgtgtatagagttctcctcttgtttttatttatttaagccactgtatacaactctgaactgaaaggccaaatactccctttcatctctgctcagtgcaattgtcctgaaactgcattactttataacattagggaaaaacatagtatttgaaaaaataaaaacatttagaaataaatgtttagcagagatattactatttcatctaagggtacatatgagaggaaaagcctcataaaatgtaaaatcagaaattatataaaatagtgaagtacagcttaggggtcaaatcaatattgttatgttcaagtaggaaacaaccattttttgtttgaagagcaggcaataaaaaaattcagcctatttgaactactgttctattaatgtgtcaattttaaataagcatcaatctttgtatctatgtattctagtttttaatgcatatttaactttaacactatgtaattatgtcaacttgtatggaatatatttatagtacttaagtacaagaaatatgaacacggtggatcacagtttagcagtattccagaaccttctatgaagagtctctagaaaaactgtaaatttcttttctctaggaaaaactgatgagaggtcagttggtacatgctgaatgtttattagacaaagctttccatttctctctttcagagaagacaattttaatataactcaaaatgcttttttaaattttagattgaatgtattttactattctgggaacttctcatcttaaaaaaaaacaaaacaagtttcttatcatccagaatagaggaaggtgcatctagaataaacatttagaaaatactttaaaaatgggtatgaattttaagccaaagccttctcgagaccatgattgtggatcctagttttggaaatgagagttctgtccatctcaaagtgatagcagtcacttggaaagaagatctattgacctctgacataagattgtttcctatactttggaattaaacatctcagtaaaccgacgctgaagaaagagatccatttacagaaagtggtaaattagtcaaacctgtagtagtcctccccacgatttgtttttcttagtttttttttttttttcatcattctgctatacgtataattcaggctgtaatttaggaaatacaatgctacttgccactagccatcctgaaagtgaaatatagtatcctggtcagagccctatttccctaatggtgattaaaactgggcagaaagcccaatgtaataaaacagtctccaagctttttcaccaaccttggtctgggaaaagcaacattagaggttttatgtcttgaaaaatatacgacgtccatatgattaagtgctcttcattttcttctcaaccacagggtgcacattcaggccttaattgtgccagctgttctcttaacccatcacctaaatattgcttttgaatataatccgtcttgacacaaagccttttaagttttctttattacaattgatctttcttatactaaattaaacttcattttctcatttgagaaaagtgagctctttggaaaaaaaataaaaacagatttttttattctgcacatgtaaaggcaattcctttttcctgtcctaattgaattcagttaagcattcaaaaccttcatcacaaagattggctgagctatttttctttttaaacaaggccaagttttgttggcacccatgacgaagaccatactgtgagagggcaggctgccagcaggtttaacattcaagtccagagtttgatgacgtcttccccaagcttcatcaagagtcttgcaacagagccaccttgcaggccattggtgtgcgtactgcacaagtgttagtttctgtgcttttcagaagatttggaaacaatgaaagtgatccattcactttttcatatacaaaaaattaacgatggaattggggaagctgagtgaagggtatgccatagcctgggccactttgtaactgcttgtcaatcttaaactatttcaaaagaaaatgttatattgaaaaaaaagccacaaaaatgaaatatgaagaagtcaaactgtagtacataaatatggctctattaaaaaaaattaaaaataatgacaataaagaatacatcatgatttttttttctttccattgctttagccacatgtgtgaaaggttcatgctattcctaaaaccctttacaattgtctttagtggagggcacaataaagaacattaggctattctttaaccaaagggaaataattttaaatggatatttaagtctgtcttaatctctacctatgctttcttctcttccccctacctctctctccccttctctgcatcccttctaacatttttccttctttgtctctccactctgacagttctgatgttgaaaatactaaaggttgggtatggtggctcacgcctataatcctggttactctggaggttaaaatgggaggatcacttgagcccagaagttcaagaccagcctgggcaacacaagtgaggcctcctctatacaaaatattaaaaaaaaaaaaaaagccaggtgtggtggtgcatgcctgtagtcccagctactgcggaggctgaggtgtgaggatggcttgagcctgggagattgagactgcagtgagctgtgatagggctactgcactccagcctggggaacagagcgagactctgtctcaaaaaataaaataaagatactaaaaatactggtagattactcttattctattgtattaagaaagtgctacttgggctaaagttttgtagcacctgattaggatcagttaggtgtggggaaaatagaatgaaaaacaaacaaacaaaaaattctggtaaacacgtcattattgctagttacctgtaagagaatgacatcaattttagtggttaggaacccagcctctgaaatcaagcagtccagtttaaaatccctatcatgctatctcctgtgacccttagcaagtgactctctgtgcctgatgtccttatctttaaaatggagataaccataatattatctacctcatacatttattttaaaaactatgtgagttaacgcatccaaagaattcccagcatagagcagcactcagtgattattagcttaattatctaattgaagacaaatgtttactactgccaagttgaaaatgtatctggatatttgaaatacaatttacaaaacctcactatagaagaacgtgaaacaggagcagtaagagataacatagttgtgtcatggacacccagcacatcacagctgctgcgactctcctgttgcagagtccactttctaaatatatgtagggcaggcatacataaataatttaggtttttgatgtttatcatacattattaaaataccaacttctagtgactgctatcttcaactcactataaggttccgcatttttattttgttgatatgtctcccatttccactctagatttaattatctaaatagaaatgttttaattgatgtcttgtgatatttgttttaaatttgaaggaaattgcccgtattttcatcagacattctccctctaatgaaataggatggaattaaataggctgtatagattcttccagggtttgaaacaacttttttaaaaggtgtctaacatttacccagtcacacagttttattggcctgccttcatttaagtagttttatttgttgagaatcaattaagaaactgttttaaacaatgaataaagtaaatattcatttctaatgtgttagcctatgtgtattcattttcaaattacaaaagcaagtgattttttttcttccagagttggacttcagtaaacatggagtattttctaccatggaaaatacattggtttctcttttaagattgatcaattttttccttatatggttgtgcaaaaaacatatatctctccttttcataaggttctgtatttaattaaaattaacaaaagaagggattttgtggggttttgttgaaattggcataggaacctgctgaaatattaatactctgcatcacttatataaaatttcattaccagaacttcactgacatttacattagtctattaatgcaattatattttgtcatattactatttgcttaatagataggaactatgataataaagatacatttttgatcaattgtctagggctaggcagtaagtaaagaatgagctggaaatcggaaattcacaataacatggtagttagatttgcttcattaatttctaaatcttatagtaacaatgttgatttcagcattctcagaaccaaaggcgagatatatgaataagccaacaaattatagaaaaattcagagattctgtaattaaatgcagtgtacctgacccctggcttgagatagaaaatagcacaattttgaactacataaaacaatatttttagtcctgtgtttattaccaaaaataaaagtgtcaaataaaaatttaaagtttttaaattacattttaaaagacttggtaaattataactttcttcagccttagcagatataatagccgaacatttcaactgttttcaaattatgcatcaaaataaaattgagttgctagtagaaagctcaaatggttttgcacaactgagcctataaatgtgttttattgctgctgtttcccatgttttacttaaataagtcacatcaatttgtttaattaaaatgtgacagtttgagctgcatttgacatttttcacaattttcctcatcattccttacctaataatgtacatactcaaatagctgataggcttctagctaaatatgcacattgactaagagtagttaatatgaaatcagtagactgtcactgtgtcaaagagggagagcttgataatgttctgccaaggatgagggtctttcttaggagagtgacaaatagaactttagaatataataatgtagtctactagactagtagactccacttagtactataccctttagctttattaactgggactttttattccattcggagggaaactattaggttctagtttacacaaggaacaataaggccattgtacactttttgttcttacacatttaattttgaatagtgttgaatttctggctgagtctgtggatacgtggaaaaaatatttaaagatgattacaagctagcattactttatttgttgttggaatcacattgttttccttagtaacttgcaattaagatgatctaaagtttgtttgtttgtttgtttgtttgttttctttactacatactgtatgttctagtccatgagcaggatttgccaaacatgatgctgctttatgtatcagtcattttgtgttgtttgaggttaataataagatttgatatcagtatttatctataataatcaggctctttcacctgtaaatagaaaaaattttaaagagtttagacgaaaatattaatgcatatacgatataaaaagtccagaagtcctgttggtatagggatggcaggaaccaggtttaccattgtaatcattagcttagtcttgttcttccttctttctctttctctttctcactctccatcccattgtttccctccctcccactcttcgtctcattttctctccatttccctgctctgcttcatctggaaatgctgggttcatcataaggctcttactccatggtgaaaagaggtaccagtaccttcgaggttacaagattgttacatgtagttaactgagaggaaaagagaccatctcctgtacagccttcacgtatcagggaagactctttttggcttgtgttacaaactgaatttccgtgagactgactctgacacagagtgtagcttactgaatgtttcctgggataaatgtccatggaagggaaggagaaggaaacaggaatgggcagagggagaacttgagctgctttgcaacccagtgacaacatctcccaacagaagaatgcttttcagcttgcctcctattgggtgaagatggttcagccttcatactcctgcattgatccatcactggatgtgggctacccaggtaaaggaaggcaatctctgaaggggcccaactactgagctttctctactgacagtaacttcctgtggctaggacattgtttcattgatgggggactgggcggtacaccaaagtgccactccatcctaatatggcctgaattcctagctgtcaaccaatcaatgtccccaagaaatggagtccatggattgacctatactatcctatggctgaggctggggtaggattggactgtgtgtggtcaaccacatctaaatcacataaaattggctccccacaaaaaaagatgaatttgactgcagatgaaggaagggaaatgctgaactgagatatacatgacaacctctgccttaggtcacttaactatgaagccagcttgtctttaggtttctgaataaagggaattatgatagtagaatacatttttattcagaacatagaatttggatatgttttatccctaaacctctcttcttctgtgttattgagcatgtattagctcaccacgtagcatacatgaaaggacagccagcttccacaaacttctgttcatatagagttgatgatgttacagttatttgtgagttaaaatacacgagcattctcttcatttatttcagaataatgtattcctatgtgtatgtatacattgattttaccgtggaacttctttttttttaagtagaacatcttagaagagaatgcacactaggaaaagctgggatgattagaccaaaatctcaaagacagcagtagaatcagtgttgacacttcactattcttacttaaaaagtattatttgtagttctgttgtagagactgatcatgtgtcttagctctcttactaaatagtaactctctgagggcagagtgctatgcttgctttctatctcatacagtatagatatccaacattacacaatatagacatgaaaaaatgtttgcataaatgactgtcagtaagttaactgtgctgatttaaaaaaaactcacagtcatcatgagaattaaggttaaaattcagtgaaataatgtcaccatcagaaatccaatgtcagcagcattgacttcagttaattcagttaattttaacctgtcagagtcagcctctctaaaagctatgtcagttctttcccctttgacacgtgtggcaatatgtgttcaggttgatatattgttggtcataggaagtgagcagatttttgcaaacatattactgaatgaagaattaaacctccattttataccaaactttctgataggcttttaacacacattatctgattatctcaaagaactctgggaaattattacccccattctaatgatgaaaaaactgagactcagacatatttaaacactaactgatagaaaaaagtcttaggattcaaacacatggcctcagctccttccattctaccaactaccttgaatttttgcctgtttctgtaagattaaacaatatttgtagtaaataaatctgaatactaatatactacatgatagtggtctgtttaaatgaactctctgcattttacagaatcattgtctgtttttatgaaatattacagccttatactgcattttatcttgtcattcctacagctgtcctattgattagggcaaagtagattttagtatcttttttagaacatgacattatatgttaacaaagcgctgagtttagaactaaagtcctgaaattgtcctcagggctttgctaaatctagattattcatacaacactaatgactgtaaacatgatctgaaattctgcatttagaaatattttcttaacatgaattttgtgcagccaccacagagaaacaaattatgtttgcttatacttttattattggctgtaatacatgttgatcaaagacaatttgtgaatacagaaaaatgaaatgtctgaaagaagagaagaatgtgagtgttataaagtgtaccttgttttaatgtttattttattactgatacctagattcaatggtacaattaccctttgtttaaaaaaaggtatttagcctgggcaacacagtaagaccttgtctctagaaaaataaaacaaattagccagtgatggtggcctgtgcctgtagacccagctagtcaagaagctgaggctggaggatcctttgagactactagtttgaggctgcactaagctatgattttgccaccacactccagcctggctgatagagcgagactccatctcttaaaaatttttaatttaatttttgtaaaagatgtttttaaaattctttattgtattttgtcgatatagtctacctattatgggtcttgtttatctacaagaaaaatgatttttgaaattggaggcaaaagtgtaataatttactgttcagttttgcttgtgacaatgccagagtttgtgttagtttttggaaaaattttcaagtcacatgagcatcttttgccttaaagagcacacaccatttactttcatccatcctttcatcatggggaagattaaatgggacacatggagccaggaaaggtgggtgacagctgggagaaattttcttagaggcctcagagcacttccagaggattgatttgaatccattttctgccagttcctttagctttacccaggttatcatccctgcagggagctgggagctgtatctcattgaacttctgatatgttagacaactctagaacattcttaaatttccttaagcttgattccttagttaaaaaaatagaggtaaaaatctttacctcctctatttcttctaagaacaatataaagaaaatgcatttgcatttgaaaaaaatgatttttaacttgtgagggccatttgtgttgacttagtaaattgacttccccctgagtgcagtagaaaggcacagactgactttttacagcactgaacgtttagtggtaggtggtcagtggtttatattttattatcaagaagtcaaagaaaatgtatttgatggcgaggcgcagtggctcacgcccgtaatcccagcactttgggaggccgaggcattaccaagaagtcaaagaaaatgtatttgatggcgaggcgcagtggctcacgcccgtaatcccagcactttgggaggccgaggtgggtcaatcaccaggtcagcagttcgagaccagcctagccaagatgatgaaaccctgtctctactaaaaatacaaacattagtctggcgtggttgcaggcgcctgtattcccagctactcgggaggctgaggcaggagaatcgcttgaacccgggaggtggaggttgcagtgagccgagattgcaccactgcagtctaacgtgggcaacagagcaagattccatcacaaacaaacaaacaaacaaaaaacatatctttctcaatgaatttgcttgggggcaaattactgcaagtcagcaaatacttattttgtgcttttattctgccttttaaataacctggccttcttgatttgagactggctagaaaataaggcctcctcaattatttaaactattgtctattgtcaactattagccatagtgaaaaaagaaatcttcttaaagaacttaaatgtgctatctctggtcccaaaggcacattgaaatcgggccgatagaaacgcgatagcagttgtgcaccatgtctgcaactgtggcagacacacaacagaagttagtaattgagctgctcattacagacagggagaggcctgttaactttctgtaactgctggagcgtgtctatagtttctttgctgtggcactagattcatcaaatgctgagtcctcctagaggtgacgggctgaccttctgtacagactgattctgactgtcttcatgtgagtcacattgggcagcgttttggtggtaccagactgctgtcaaagcttatttccctctctgttaactgtttgaagatttatgtaccaacaggaatttaatcagtgctgtactttaaataattttgtgcttggctcaaacaagaagagttaatcaattcattagaggtggattataagccccacctcctataacttttttttttattgtgtcagaagtttggaaataaaatacatgttattattgaaaacactttattgaatgaggatttcaaaaattaggtcatttcttttcctttatttctggattgttttctcctgcatgacatttgacactttgtcaagcaaacaattgaggatagcccataaccaaagattacctgtcgttgggaagcaggtgtcacgctgatgaatcagagccagataaatctaggccaacagaggtatgtttgcttatagaactaagcaagactttctatgtggaagaactagaagaccaacagatataagctgttagttttagtgttggcaccaacactgctactataatcccacactagtctccaaatatttttgtgcacattcaaaattcacatgaatttgtcatttgcactttctaacttaacactcctgtgattaatctgtggctggatagttgtagatcagggatctgttagttggaaatgttcccttctgaaagggcagaaggttagggcctagctttcttgctgtgataaatgtcttttcagcttctgcttctttcttgttgcttaaattggggatggagaaagctcccaactaccattcattgtctaacctcataccctgctttatcttcttcatagcagtcatcattctcttaagtatttgtgttccactataggaatataagcttcaaaagtgcaggaaccttgttgacaacttcttcaccatcattatatcccagttcctagaaaagtatctgccttgccctgaagcacgtcttcaaaaaacattagttaaaagaatgaataactaacttgcttgtatattctatttgcttgggaaatcttttctttttttttaatggagtcttactctgtcaccaggctggagtgcagtggtgcgatctcacctcactgcaacccctgcctcccagattcaagtgattcccctgccccagctgagtagctgggactaccggagtgcgccaccatgcccagctagttttttgtattttagtagaggtggggtttctccatattggccaggattgtcttgatctcctgacctcatgatccacccgcctcagcctcccaaagtgctgggattacgggcatgagccgccacacccagcctagggaaaactttcttacagtagaataaagatgcagatatgtctcggttcacagtcaggctgtaaacattctatttaggtgttcagcaccacttcaattatactaaagatgaaattggtcagatcagaaatttaaccatcatttgtaatgttttgcttgtggttttaaatacgttattgaaaaattacaaatataagattgtttataggtgaattataggggaaaatgtaagttgatttaagctattttcattccaatataatactttctgctccagtgctacttcaggggaaaattaaagcattaactcttgactagtacagttgaaatataatggaatctgaggaagtacttaatatgtaacatggattaacagcagatctgtgtcatagattaatattttcagacttatgggaaaccctaacttttgctgcagctacatttgttccagacatgggatttccttttgtagtgtatagattccattagaattctgaccgttttttggtcccttttatgtaacatgaaatgcaatgataatattaaaatgtatgaaaatatactttatgataaataggtctgaagtcaattctcatatacctcttttggggatttgcaattttatttattaaattatgtagaactttagttataacagcaacacagaaggagttacctacacctggactcacccgagagaaagcctctgactcagagaagtgggtccagaaatctgtggaatgctccgttttcgcttattagtagtgcattgccaaagctttcaggaaattagagctttggggaacagatttgctttattgtcaaggattgcctatagctgtacattcctttgaaattcaggtttcactcagatgacaaaatgatggtttggtaggcctaggaggatgtgtactttccaaactggagaaaatctaggttgtggtattaatcttaaaagcaccccaatgttagacacagctgcctgcctgacatgtgcctcaggtttatcctacatgtttacaaagctcagttgtaaatctgagtattaatgagaagatgttccatgaaagattttcaacaaataattaataatgcattcagttaaccataaaggcatttcaaggaaaaactcagactttgaagacaaatgatttgaataaatggataaaaataagcttaggggcttttgcagattcatcactcaactctcttacttcattatccacataaatacagcattattcagatgcattttaaccttcaaataactcatacttcttattgctgtttttatcataaaccttgagtaaggtagcctcttaaactatttatatacctaacatagataaaataaaaattaaaaagaaggaaaaacaaaaggaacttggttgggaatatgtaagaactttttgccatacatctttgaggtaatgacaacaagtttctttaaaaaataaatactgctggattcctgggcaagacggccaaacaggaacagctccggtctgcagctctcagagagaccagcgcagaaggtgtgtgatttctgcaactgaggtacttggttcatctcaatgggactagttagacagtgggcgcagcccatggaggtcgagcagaagcagggtggggtgtcgcctcacccaggaagcacgaggggtcagggaactccttcccctagccaagggaagccctgagggactgtgccgtgagagacggagctatctggcccacatactacgcttttcccatggtcttcacaacctgtagaccaggaggttgcctcgggtgcctataccacaaaggccctgggtttcaagcacaaaactggatggtcgtttgggcagacactgaactagctgcaggagttttttttttcataccccagtggcacctggaaggccagtgagacagaaccattcactcccctggaaaggggggctgaagccagggagccaagtggtctagctcagtggatcccacccccacagaatccagcaagctaagatccgctggcttgaaacacttgctgccagcacagcagtctgaaatcaacctgggatgctcgagcttggtggggggaggggtgtctgccattactgaggcttgggtaggtggctttcccctcacagtgtaaacaaagctgccaggcagtttggactgggcagagcccaccacagtgccaaaaagccactgtagcaagactgcctctctagattcctcctctctagccagggcatctctgaaagaaaggcagcagccccagtcaggggcttataaataaaactcccatctccctgcaacggagcacctggggaaagggggggatgtgggtacagcttcagccgacttaaacgttcctgcctgccagctctgaggagggcagcagatctcccagcatagtgctcgagctctgccaagggacagactgcctcctcaagtgggtccctgacccccgtgccacctaacagggagatacctcccagcaggggacgacacacacctcatacaggagagctctggctggcatctggtgggtgtccatctgggacaaagcttccagagaaaggagcagtcagcaatctttactgtcctgcaaccttcgctgatgatacccaggcaaagagggtctggagtagacctccagcaaactccagcagacctgcagaagagggacctgactgtcagaaggaaaactaacaaacagaaaggaatagcctcaacatcaacaaaaaggacaaccaagcaaaaactccatctgaaggtcaccaacagcaaagaccaaaggtagataatccacaaagatgaggaaaacaacagtgaaaaaaggctgaatgtcccaaataccagaacacttcttctccaccaaaggatcataactcctcgccagcaagggaacaaaactggacggagaatgagtttgatgaaatgacagaagtaggcttcagaaggtgggtaatagcaaactcctccgacctaagggagcatgttctaacccaatgaaaggaagctaagaaccttgataaaaggttagaggaattgctaactagaataaccagtttagagaagaacagaaatgacctgatggagctgaaaaacacagcacgagaacttcatgaagcatacacaagtatcagtagccaaattgatcaagtggaagaaaggatatcagagattgaagatcaatttaatgaaataaagcgtgaagacaagattagagaaaaaataataaaaaagaatgaacaaagcctccaagaaatatgggaccatgtgaaaacgccaaacctacaattgattggtgtatctgaaagtgatggggagaatggaaccaagatggaaaacacacttcagtatattatccaggagaacttccccaacctagcaagacaggccaacatcaaattcaggaaatacaaagaacactgcagagatactccttaagaagagcaataatcgttagattcaccaagattgaaatgaaggaaaaaatgttaagggcagccagagataaaggttgggttacccacaaagggaaacccatcagacacagcagatctctctgtagaaaccttgcaagccagaagagagcgggggaaaatattcaacattcttaaaggaaagaattttcaacccagaatttcatagccagccaaactaagcttcataagcaaagaagaaataaaatcctttgcagacaagcaaatgctgagggattttgtcatcaccaggcctgccttaaagagctcctgatggaagcgctaaatgtagcaaggaaaaaccggtaccagacactgcaaaaacaagccaaatgtaaagaccatcgacactatgaagaaactgcatcaactaatggccaaaataaccaggtaacatcataatgatggaaatcaaattcacatgtaacaatacgaaccttaagtgtaaatgggctaaatgccccaattaaaaggcacagactggcaaattggttaaaagagtcaagacccgctggtgtgctgcattcaggagacccatctcgtgtgcaaagacacacatgggctcaaaataaagggatggaggaagatttaccaagcaaatggaaagcaaaaaaaaaaaaaaaaaaaaaaaaaaaaaagcagggatggcaatcctagtctctgataaaacagactttaaaccaacaaagatcaaaaaagacaaagaaggacattacgtaatggtaaagagatcaatgcaacaagaagagctaactatcctaaatatatatgcacccaatacaggagcactcagatttataaagcaggttcttagagacctacaaagagacttagactcccacacaataatagtgggagactttaccaccccattgtcaaataagaccgatcaaggagacagaaaattaacaaggatattcaggacttgaactcagctctggaccaagcagacccaatatacatctatagaactctccaccccaaatcaactgaatatacattcttctcagcaccacatagcacttattctaaaattgaccacataatcggaagtaaaacactcctcagcaaatgcaaaagaacacaaatcataacagtctctcagaccacagtgcaatcagattagaactcaggattaagaaactcactcaaaactgcataactacagggaaaccaaacaacctgctcctaaatgactactgggtaaataacaaaattaaggcagaaatcaataagttctttgaaactaatgagaacaaagacacaatgtaccagaatctctgagacacagctaaagcagtgtttagagggaaatttatagcactaaatgcccacaggacaaagtgggaaagatctaaaattgacatcctaacatcacaattaaaagaactagagaagcaagagcaaacaaattcaaaagctagcagaagacaagaaataactaagatcagagcagaaatgaaggagagagagacatgaaacacccttcaaaaaaatcagtgaatccaggagctagtttgtttgaaaagattaacaaaatacatagaccactagccagaccaataaagaagagagaagaatcaaatagacacaataaaaattgataaaagggagatcaccactgatcccacagaaatacagactgccatcagagaatactataaaacacctctacacaaataaactagacaatctagaagaaatggatacatttctggaaacatacaccctcccaagactaaatcaggaagaagtcgaatccctgaatagatcaataacaagttctgaaattgaggcagtaattaataggctaccaaccaaaaaaaacccaggatcagatggattcatagccaacttataccagaagtacaaagaggagctgttactattccttctgaaactattccaaacaataaaaaaagagggactcctcactaactcattttatgaggccagcatcatcctgataacaaaacctggcagagacacaactaaacaagaacatttcagcccaatatccctgatgaacatcaatgcgaaaatcctcaataaatactggcaaaccaaatccagcagcacatcaaaaacttatcgactatgatcaagttggcttcatcctttggatgcaaggctggttcaacatatgcaaatcaataaatgtaatccatcacataaaaccaatgacaaaaaacacatgattatctcaatggatgcagaaaaggcctttgataaaattcaaaaccccttcatgctaaaagcactcaataaactaggtattgatgaaacatatctcaaaataataagagctatttatggcaaacccacagccagtatcacactgaatgggcaaaagctggaagtattccatttgaaaactggcacaagaaaaggatgccctctctcaccactcctatttaacatagtattagaagttctggccagagcagtcaggcaagataaagaaataaagggtattcacttaagaatagaggaagtcaaattatctctgtttgcagatgacataattctatatttagaaaacaccatcgtcaggcccaaaatctccttaagatgataagcaacttcagcaaagtctcaggatacaaaattaatgtggaaaaatcacaagcattcctatacaccaataatagacagacacagagccaaatcttgagcaaactcccattcacaattgctataaagagaataaaatacctaggaataaagcttacaaggatgtgaaggacctcttcaaggagaactacaaaccactgctcaaggaaataggagaggacacacacaaatggaaaaacattccatgctgatggataggaagaaacaatatcatgaaaatggccatactgcccaatgtaatttatagattcaatgctactctcatcaagctaccactgactttcttcacagaattaggaaaaagctactttaaatttcatacagaaccaaaaaagatcctgtatagcctaagcaaaaagagcaaagctggaggcatcatgctacctgatttcaaactatactacaaggctacattaaccaaaatgttatggtactggtaccaaaacagatacatagaccaatggaacagaacagaggcctcagaaataatgccacacatctacaaccacctgatctttgacaaatgtgacaaaaacaagcaatggggaaaggatttcctatttaataaatggtgttgggaaaactcgctagccatatgcagaaaactgaaactggaccccttcgttacactgtatacaaaaattaatgcaagatggattaaagatttaaacataatacctaaaaccataaaaaccctagaagaaaacctaggcaataccattcaggacataggcatgggcaaagacttcatgactaaaacaccaaaagcaatggcaacaaaagccaaaattgacaaatgacaaatgtgatctaatgaaactaaagagcttctgcacagcaaaagaaactgtcatcagagtgaacaggcaacctacagaatgggagaaaatttttgctatctatccatctgacaaagggctaatatccagagtctacaaggaacttaaacaaattcacaagaaaaaacaatcccaccaaaaagtgggcaaaggatatgaacagacacttctcaaagtaagacatttatgtggccaacaaacatatgaagaaaagctcctcatcactggtcattagagaaaagcaaatcaaaaccacaatgagataccatctcatgccagttagaatggtgatcattaaaaagtcaggaaacaatagatgctggagaggacatagagaaataggaatgcttttacactgttggtgggaatgtaaattagttcaaccattgtgaaagacagtatggcgattcctcaatgatctagaaccaggaataccatttggcccagcaatcccattactgggtatatacccaaaggattataaatcattctaccataaagacacatgcacttgtatgtttattgcagcactcttcacaatagcaaagacttggaaccaaccaaaatgcccatcaatgttagactggataaagaaaatttggcatacatacaccatggaatattatgcagctataaaaaagaacgagttcatgtcctttgcagggtcatggataaagctggaaaccatcattctcagcaaactaacacaggaacagaaaaccaaacaccacacattctcactgataagtgagagttgaacaatgagaacatgggcacagggcagggaacatcacacaccggggcctgttggggaggttgggggcaaggagagggataccattaggagaaatacctaatgtagatgactgtttgatgggtgcagcaaaccaccgtggcccatatatacctatgtaacaaacctgcatgttctgcccaggtatcccaaaacttaaagtataattaaaaaaaaaaaaaagccagctaaatcccactgaaaccaagatggttatgagagtgacctttggtcatcctcactgctatagtcctaccagcgccatgacagtttacaaatcccatggcaatatcatgaagttaccctgtatggtctaaaaaggtgaggcatgaataatttaccccttgttaggatataatcgagaaataatcatacaaatggacaaccaacagccctcagggctgctatgcctatggagtagctattctttattcctttactttcttaatagacttgctttcactttaaaaaacaaataaataaatattgccatcttccaaagtttttgtcccactgaaaacacagaaagaactaaaagagattgagatattttcatttcaaaaatttatcattggttttcaggtttcttcaaagcatgttttcccctattgtttctgcctgaatttgaatatgccagaactccttagagaattatataggtaggaaaatctgtcagtgctctaaacttaaaaacagaagatgaaaaaataatatatgctggccatatatgtgtatatattccaccttatctgtgatttttgttatttctttgccttaataaaagacatcggtaaacaaagccacccgaagtttggactgggcggagcccagcacagtgccgtaagctgctgtagccagactgcctctgtagattcctcctctctggacagggcatctctgaaagaaaggcagcagccctagtcaggggcttgtggataaaactcccatctcccggcgacagagcacctgggggaagagggggatgtgggtacagcttcagccgacttaaacgttcctgcctgccagctctgaagagagcggcagatctcccagcacagtgctcgagctctgctaagggacagactgcctcctcaaatgagcccctgacccccgtgcctcataacggggagatacctcccagtaggggatgacagacatctcatacgggagagctccggctggcatctggtgggtgtccctctgggacaaagcttccagaggaaggagcagtcagcaatctttactgtcctgcagcctctgctggtgatacccaggcaaagagggtctggagtggacctccagcaaactccagcagacctgcagaagagggacctgactgtcagaaggaaaactaacaaacagaaaggtactggatattcaatctttataagcttagttttctcctaggaataaaaatagtatctgctgtgtttggcctttgtgaggattaaatcaataatgcatctgacaaactttgtagaatgattgagttgtattaaacacttaatactcatttcctataattgttactcatttcctataattgttgttttgtattagaatggtactctagccttcataaaacaaattccatgatttagacatttgaaagttcttcattttcaactgacatttatttctagttactgcatcacctagtcattttatgttcagtgttgtgacagcaaatgggtgaaatagtttcaatttcccagcatgtaactggcctttttagccttaactttcttttccagcattgttacggcagctacagcaaacatgtcagagtacagaacattccattaagagccttatctcatgcctcgcttcctatgatgttttgtatgaataatacaatgtctagaggtgaaattagttggagtgctcatgactcagcctctttttctggggagtgagtcattccacatttatagattcctgactttgtgccgtataccacactaagtgcttggaatacaaacatagatttgctgggtcattgacccagagcagcccacagtctgggcaggcagggtatggcattcattaagaacaatatgggcttacacatagccagcactctattaatgttatatctacctgtcaaggcaaagtgtgattaaatatacaataatatgagctgtctagacaacttaattctatgttttggaacatgtacctctgaccctatagccctatattggtatattttgcctaattatatcaccacaaatttaactcctttattgttttgtttggatactgagtttttattcctttgcatatcacgtaaaatcataccctccatgaataggtcagttgcctgatgaatacctttcctttattatcctgccagaaactcacacttaatgtgtctaataaagcccattatcctctacttttacccagcaacctgatctcccttcaggctttcctgtttctaagaatgtactgggagtctgtttttcttacactctcaaaattctcttggctcctttcttcatcctgtgcctttcctggccaatgaatccttaaattctttttttgtgtgtgtgagacagggactctgttgccaagggtggatttcagtggtgcaatcatagctcactgtaacctcatatgcctctggcttcagcctccccagtagctaggactacaggtgtgcactaccatgcctggctaatttaaaaaaaaaaattgtttttgtagtggtctctctatgtcgcttatgctggtttcaaactcctggcctcaagcagtcttctgccttggtctcccaaagtgctgggattagaggtgtgagccaccatgactggctttaatccctaaattctgtatggactgtaaatactgttatggactgagttgtgccccaccccatccatatgttgaagttctaagtgcccgtgtgactgtttaaaaatagggcttgtagcaggtaattaaggttaaacaaagtcatcagagtggggccctaatccagtagggttggtggcctcataagaagaggaaaagagagttctctaaatttccccacccatcttcatgtctttctttctccgccatgtgaggatatagtgagaatgtggctgtctacaagccaggaatatagccctcgccagaacctgaccatgttggcatgtgatctcacccctccaacctccagaactgtgaaaaagtaaatatctgttgtgtaagccacatgtctagggcattttgttatgttagactatattaggccatctcttgcattgctataaagaaatacataggactggaatttacaaagaaaagaggtttaattggctcacagttctgcgggctatacaggaaacatagtgctggcatcagctcatggggaggactcagggagctttttctcctggcagaaagcaaagcaggagtgggcacttcatgtagtcaaagcagaagcaagcaatggagagaacaagagagaaagagagagtagaatgggaggctccacattctcttaaatgaccagatctcatgaaaactcactatcacaaaacagcaccaagccataagggatcacctccatgatccaaacccctcctactaggccccacctccagcactggggattacaattcaacatgagaattgggtggcgacaaatatgaaaactatatcatcctgcatctggtcctttccaaatttcatgtccttctcacattgcaaaatacagtcatgctttcccaatggttccccaatgtcttaactcattccagcattaattcaaaagtacaaagcctcatttgaaacaaggcaaatcccttcaatctacaagcatgtaaaatcaaaaagagttatttactcccaatatacaatgggggtataggcactgggtaaacattgatattccaaaaggaagaaattggccaaaggaaaggggctaaaggccccatgcaagttcaaaacctagcagggacagttattaaactttaaagctccaaaataatatcttttgactccatgtcttacatccacagcacactggtacaatgagggggctcctaaggccttggttagctctgcccttttagctttgcagggtgcatcctccccatacccctcagatgctctcacaggttgttgagtgcctgtggcttttccaggtgcaggatacaagctgctggtctgaggtctggagggtggtgacccccttctcacaactccactaaggaatgccccagtggagaccagatgtgagggttccaacttcacatttcctcttggcactaccctagtagaggttctctgttggggctctgcccctgcagcaggcttctgcctgggcatccaggcttttctacacatcctttgaaatctaggtggaaggtgccaagcctcattcactcttgcactctgtgcacccgcaggcttaacaacacatggaggctgccaagacttacagcagtttgtgctctccagagcagtggtatgacagtgtctggggtcctttgagcacaggctgcagccagagcttccagtgcagtacagtatcctaaggctgtgccaggcaatggggccctggacctggcccacaaaaacattcttccctcataggcctctgggcctatgatgggaggggctgccatgaaggtctctgaaatgccttcaaggcctttttcccattatcttggctgtgagtgtttggtggggtttcattatgcaaatttctctagcaagtggttgttccacagcctgcttgaattcctctctcaaaaaaagctttttctttctctgccacatggttagatgaaaaattttctaaacttttatgctgtgcttcccttttaaatataaattccaattcttaatcttttatttgctcctgcttctgagtgtaggttattagaaacagccaggcctcctcttgaatgtattgctgctcagaaatttcatctgccagatatgctgtatagtcaccatgaagctcaaacttccaaagacccctagggtatggacacaatccagccaagctctttgctaacacataaaacatgtgacctttgccccagttcccagtaagttcctcatttccatcagagacctcatcagcctggattttgctgtccatatcactatcagcattttggtcacaacaatttaactagtctctaaaaaattccaaactttccctcatctttctgtcttcttctgagccatccagactcttccaacctcagctcattacccagttccaaagctgctttcacatttccatgtatctttatagcaacaccccactcttcagttcaatgtattaggctgttcttacattgctataaagaaatacccaagactgggtaatttattaaaaaaataagtttaataggctcatggttctgcaatccatacaggaaacacagtgccggcatcagcttctggggaggcctcagggggcttttactcatggtggagagcaacacaggagcaggcacttcacatggtgaaagcaggagcaagccagaaagagagacagggggtggggaggaaaaggagagggagaatgccgggaggaggtggcacacacttttaagtgactggattttgtgagaactcactatcatgaagacagcaccaagccatgagagctctgcccccattatccagtcacctccctccaggccccacctccaacaatagggaataaaattcaacatgagatttgggtggagacaaacatcagaactatatcacagtctcagcagactaatacacatatccatgcaatagttgtaacactctcctttatatggacactgtctccacctgaattgtgtcttcattaccattcacctggacttctgaaggagccacttttttgaacacttctttaagcactcccctctctgatccaatctacataatattgccagattaaatttcctaattatgccattcttgaatttaaaaccttcagtggtccactttcacctacaaaattaaatatgtttaattgaatagcctcctcagattgtcattcaaggtcattacttcctatatagagccaacttagcttttcacccaattattgctcttcttatgggtcatactccaggctaggtatttttccaaacaccccctgggctttgattcttctgttactttgtttctgtgttgtcctgtccattgtctgaattgctctccttcccactccatctccacctatcaaaatcccttacctccttcaagggctaactcaaatgcaacttcctctgtgaatctttatcttcataacaggatttttctccccttcactgatctcccaaaagccctgttagtatttccttgtgacaataggaattttttttttccatcgtggctttttgtcttttggctttttcacaacctcccttatcccactagattctaactaagtgaactctttaaggttaaagaacattggatccctaaaatactaaatgatactaaaaaacataacaaacaaacaacaacaaaaaaaccctacccagttgggtatggtggcttatgcctataatctcagcaatttcagagggtggatcacttgagcccgggagtttgagaccagcctgtacaacatagggaaactctgtctctaccaaaaaaatagaaaaattagttgggcatggtggtgcatgcctctagtcccagcaactcaggaggctgaggcgggaggatcatctgaggctggggaggtcgagactggagtgagccatgatcattccaatgcactccagccgggacaatagagtgagaccctgtctcaaaaaaaaaaaaaaaagcctactctataccttaaaaatatgagaattacaagaattacaaacaaaaaacatttccatttttttaaatataactgcagtattcccaacatttgtttctgtaaggtgtaactccagtagtaacttttctgttacttaagcagtaacaatttctgtaatttgaaaactcaagtgtaactttaacaagggagaagcataagaaatataaaaattgtgaattttcagctcacaattaattttgataatccaatagctaaaagatgtctgctattttcatcttgtattccttgtgaggtataatcaggcctatttgagtttgacataggctttataatgttatctgaccatcacaatatgatttataatatggaggcatgaagtcatttctcattggggcaggagtgtggcaagggggaagaagagctttaccaattaactcaagattatttggtgacatttctcttaccttttaggtgaggagaaagagacagaggatggagaattggtgcttttagtatgctgatacattaagctgcctggaagcagatgctaaatcctattgaaaataattttatttgcgttttgcttagggtattgtttagcaaaatactacacaaaaagtcttgacctgtgtgtttgaaatggcagatgttcacagtgaggactgagccttggggcaacatcaatcttcacaattctgcacctatttgctcaataactggcttggttggaaaaaaaggaaaaaaaaaagttccagggagttatttacaaagcatccgctcctggcactgcaaatgaaagtgctctccttaagataagaaaagcaagcaaacaaacagaagccacaggacagcttgagcccaccaggtcaaaaatgaatacctcttttccctcagaactgtgtttccaatatttttatataaaaattgtatatatttaagtgtgcaacatgttttgatatatatatatacacacacagtgaattgattactagagtgaagcaaattaacatgtctgtctcctcacacacttattgttttaaaaaataagaacacctgaaacctattattttagcaaattttcagtagaccttacaatattattaactatagtcgtcatgctatacattagacctctaggtttagtcatcctgtataattgtgaccttatatcttttggctaacatgtcctcatttcgccaacctccccacctccagataaccaccattctactccgcttctatgagttcagctttttaagattccacataagtgagattatgcagtatttttctttctgtgtctggcttatttcacttaccataatgccgttcaggttttttcatgttgttgcaaatggcaggatctcccttttaaagtcttaataatgttccattgtgtatagtaactcacaattttttaatccattcatctgttgatagacactggttgttttcatattttgactgttgtaaataatgctgcaatgaacacaggagtgcagatatctcttcaaggtaccgacttcattttctttgtgtattttccctgtagtgggattgctggatcaaattgtagttccctttttaatttcttgaggtacctccttactgttttccataccgcttgtaccaatttacattcccatcaacagtatacagtgttccctttccttttcaccacatccaacacttattttttatcttcttaatgatagccatactaacaggtgtgagatagctatctcattgtggttttgattttcatttctctgatgatttctgatattaaacaccttttcataaacttgttagccattgtcatgtcttctttggaaaaatgtctattcagggtcctttgctcatttttaaatcaggttatttttatttatttgctttgagatattgtttcatgtgtgttccttatatatttcggattttttttctttttttttttttttttctgagacagggtctcattctgttgcccaggcaggagttcagtgcacagtcacagctcactgcagcctcaatttcctgggctcaatcaaacctgccacctcagcctcctgggtagctgggacaacaggtgcacatcacaatgcccagctaattttttgtattctttgtaaagttcgggtttctccatgtttcccagactggtctcaaactcctggactcaagcactccaccctccttggcctcccaaagtgctgggattacaggcatgagcccccacgcccagccctatattttggatattaaccccttatcagatatatggtttgcaaatattttctcccattctctaggttacctttttattttgatgattgtttccttttttggacagtttgatgtagccccacctgtttgtttctgcttgtgatgtctgagctcttggtgtcatattcaaaaaatcattgccaaagtcaatgtcaagaagcttattccctatgttttcttctaggagttttatggtttcaggtcttacatttaagttttcattccattttgggttgatttttgtgcatgatgtaagataaaagtctattttcattcttttacatgtagtacccagtttacctaacaccatttattgaagagactatcctttcaatggaagtaatgtaagacaaggatgggattttattttcttattctcaccacgaagggtattttcaactgtttctttaaatctgacatagaattggaaaaaatacgacagtaagcacctttattcatttaacaatatttattgatattttgtgtgctgcaaacgttgggttcaaatacaaagttcacatacctaaaagagtattaatattttgaatacagtttgtttttgaatcatgctgtattgaaaccccatctctactaaaaaatgcaaaaattagttgggtgtggtgaaacgcacatgtaatcccagctactcaggaggctgaggcaggagaatcacttgaacccaggaggtggaggttgcagtgagctgagatggtgccattgcactccagcctggttgacagagcaagaccctgtctctggaaaaaaaaaaaaaaagagagagactaagcaagatttttcttggagatggggcttccagttgtggggaggaggaacactggaagagggacaagtaagttggaatgtctttccagacacattatggaatacataaagaagtcaggctcctgtgtcataaaactgaactttaaaaaaaaaaatcccacagtatcattttgtttttgctatgaaagtatatatttgggagtgcacgtagaagaaatgaaatccagtctatttaaaagaatattaaagatatcaggatgctgatttgtgttaaagagcaattagcaagaagtagctatagtcaaatgataaattgaggcctaaaacttgcaagcaaacaaatgggcagtttcaggttagactttccctgactccaggcaactagtgaaccactttctctttaaagagttgttaagtggcaatatcatcctggtattcattgctcagtatgcatttatcaattgtagagcaggtttttgtatgagacaccatgcaagatcctaggataacagcatcacttattttatattgtagtaaaacatgtaacgtaaaatttaacattttaaccattttaaagggttcagctttctggcattaagtacattcgcgttgctgtgcaagctatcattttttttttcctagtgaatatttagatataaatcacaatccctttccagtgtctccttttttcttaggggataatgattgataatatgattaaaatgaacacataggcagtgtatccactctgtctttcatagcctagtgttcttatgtacattctattttagccatctcttgcacacacagtagtgcacatgcaacccagccacacatacacagtcactgagtgtgttgaatcactgtccttcccactctcctagcattttttcttcatattttagagacatattttttcttctcttttttcctttactctcctagtatttttattttaaatttctcatactttctctttaaatttgtggagcaaaacaaaaaataaacaacaagaaactgtgcttaacgggaatgttccaaatgttctcagtttatggcacccttagtatctcagtaattttattttcaagatcctctaggccaaaagatgtacctcacagtttcatttaattaacataatatgtttaagtcctaacaacttagtagccttttgaaaaaatgatacacataaattgaaagcaaatctatttttattttatgcttagaaacccacaatcacttactaatgggatttttgcctgttgaatactgcccagccctcaaaccttgaagtcacactggacgctatcattcttatttcctttaatttttttatggaaacaaggtttttgtcattcttacttcatgttgattttcatgcagtatttgcttttatatcacaaacaaaatcaaaacccaactttgcaaagctgtaacatcattgaaaggaatgtagcatgatctaatattgaaactgcaaaccactttaatagtttttgtgctgcctaatggatactgctgtgggttttttgtttttgtttttgttttcatatattgaaaacattttggccaggcacggtggcttatgcctgtaatcccagcactttgagaggccaaggtgggtggattgcttgagttcaggagtttgagaccagcctggggaacatggtgaaactccatctctacaaaaaatacaaaacttagtcaggcatagtggttcacgcttgtagttccagctactacggaggctgaggtgggaggaccgattgagcctgggaggttgaggctgtagtgagccatgatcacacccctgcactcccgactaggtgacagagtgagaccctgtctcaaaaaaaagaaaagaaaagaaaaagaaaacatttcaccattcccctgagagtttacagtggtgccctggaccaccatgacagttagagagttgttggctttatagccaaaaaataatatttgtatccaagtaaaataatgtcattagttggaagtcaagatagatatactaaaggcattaatcttaaatgtccttcataatttcctcagatacttaaaaaaaaatctccacagatgtatcaacctatcatttcgttattgtaggacaaagtttacttttcttaaacacctgcccttaggattaaaaatcaactatttcatattcagttgtattttctgtggtttactagtattttctttgtcttattttatactgttcttttcagtaaataactagttttaggctaatttagtttttgggcttagcataggagtctaataatgaaacatttctaacatgtagaagaacatatgctgttttctatccagttaactcacaaacatacttctagaacctaacttgctttttaattagagactgccatagatgctccctgtggcgagttgagtctcttttgtcattttgaagtggttttgtttactatctgttcaagagacaggctgactttggcacaaaagtttgtttttgtccctggtttaccttctttatacttccatttgacaacatgcttttctgcatatttacttctcagcatattttagtagcaaggcttaggtgcaagagaccactggaaagattgatcgtttaccactggaattgtcttatttgaactttgctacctttagcaaaggtttggactgattgtcgacccaggactaaaaatcttcagattctctgtgcatattaaatcagattaaagacctgtgtcagtctgtgcagactgttctaacaaacataaaagaacagaaatttatttttcccagttctggaagcagtgaagttcaagatcaaggcagcagcagattggttttgctgaggtcctgcttcctgttttttcctccgccttcatatggcaggcagaaggtgtaagagcgctctctgtgatctcttgtataaaggcacagtccactttttatatttctgggatctcttttataggggcagtaatcaccttccaaaggccccacctccaaatatcacattgggggattaggatctcaacatatgaatttggggtggtggggacactagcattcagtctatggcaggatcaaaatgcctgagttttattatttttgattaaacatctcttaagagcaatggtagtatattaagaacagaatgtgctaaaaattctttttggttggttgttttagaatataaacataggacttctactttaaataagtataaaataaaaataggacctaattttggcatttaatatatatttttttcaataaaatgtagaacgtatttttaagtttaaagttgtattatacataaccgtcacgtattgtaaatggatgtgtttcagtcagtgcattttatggagtgaggaacaagtcacttctgattttatcttcctccttagtgaaagaaaaagccagattgttcaactgatttaacttactgggtatttttcttttcttcttttagattttattgatctaatccaaagtatcttataacttctggctggaattaaggtcagtactatatttgtgtcaatcatgaataaactgtgaaataaaataaaggcatcatgggtctttagatagctgtgtcagaaatatgcttgcaatgtgtagtagaagctcaaatttagtaaaaactggatatatttcggagttggcctactagcaaacatggttccctaagtactgtttttctaattagtataatttatttggtttttgaatgttgaatttatttaatcttactactacctgagtttcgaataatgaaaaaaatccaactcgaattcatttgtttaattaacagaaatattaaaagagtgacttcttggaaggctgacctttcaaagaatggtcagcttcctgaatttgcaggaaaacactttgaattccacaattatatactcatagagaatatatttcgtaaagagggtagaattgaaaacgtacttttcaataaaaaatttcagttagcagagtgttaagatgtcattccttttgttctgtgctttcattaattggccttaattgagactcgaaactagcttaactgagtttagagtagtaacagaacctcagaaggccctcacagcaataaacttgggattttatttatgccttctattttttttcaacatgtattcagattgaaaaaaaaaacactaaacactgaatgaaatgaagacttttattgcttatgaaagaacaacatgccagttgttgctaaactttttgtataggcttttgattaataattaacataaaggaaaacattggcttttcatttgcccttacactaatcaggaattttccctttaaagcccatgtttaacccttcagattgcagtgtctgtcatataacaggcacactgtaaatatgtaccttttctgacctcactttcctacaaccaaatacatataagcacacagacacacagacacactctctctgtcccacacacacacacacacacacacacacagagatgaaaaactactattatttctcttttcaggttcaaactgtgctttcctatcttcgaaatctgtatcgaatgaagcaaatagaatatattaaaattatgcctatagataattggaaacttaataaagaaaaaaggtgaaatgtctacaagtattggtttcaagtctataaactgtattattttattaagtgtttttatatagttcggggtcaaatttattaaagtttctcttttttattcacttctgcatatgctatggagatttgtgaacatttaaatgtgcaattttttaagattttttgaatttttttctacttttatcccctactagcccctatcccatccacctacaaaaccaaaattacaagtagaatgagatttttgtaaagtatacatcattgaatcagtaatattttcaatgcacagagttaagttttaattataaataaatctgtatgagaggtaaacttttcctttctcttctttaataagaaataaactcttcccttcctgatttttttattttatagtttatatggtaaacatgacaatttgcaatctcatcttgctctgaccacttaccagaatgaaagaaaactgaaaagaaaaaagatttttgttagactataaaaaactaacagtaacgcacaaaaatttttcataatctgatcccctaaccatcttccacatggagatttctgttgtgggaatacgaaaatcgagtgtgtttggtcaagatgacttgcctattttcaaataaataaataaatatatcagtgaaaataacgtgtacatataaatggaaacatgtttaagcctctcttattaccaggtcttcccacttggatatgtgtggtttagtatttattagtattgttttcccttctatctggaaatgaaaataatattaaattacatttggttaatcagttatctaaatcacattttgtaaaagcagttagatgtagtaagtctcttaaaactatattaactcactagaaacagccaagttatcaaaacagaatatatgtaatggaaattaccatttttttcaactataactaagttacttttggtttaaaataaaagagtttccctcacagaaaaagcatgtttatctgtaaaactgttagctgagcaaaataactagtgttgccagataaaagaaagctaccgataggggtatataaaataggacatcagaaatgccattgcaatattttatcaattctgtgatgcatgtaattttacattaagttatgtaaaattaagtgatgctatagttaaattgacagcattttttttcctagtggtaaatgaggtatgtcttgtaatgaatagcatcttagattttatgaaacacaatattactgaatttagactggaaacgtgttttaatctcctaaagttattacaaaaaaaaaaaaagtcagaatgaaatctagaaacaaggaaggtaaatttggcattgattctcagcaacattttaggccacaatttttgcctttttaaaaaaatgtgtattggtttttctgatctacttctttttctttattattaatactgctaccagcattttggtatattttcctccagttttttttgtggtttgttttcacaaaagttaaattaaattttctattctatacattgcagttacttgaaaaggtgatttttaatggctctgtgatatactatcctatggatatttcatagtttatttcaccatttactcattgttggacatgcagaccatttttaatatctcactattataaatagccctgcaataaatatgcttctaaaatgtttatgttcactgctgacattgtacttaggatcaatttgtagaagtgggattatgtagtgtaaagaaataaatatatttgaggtgagtaacgtgtacattatgttccccaaaattatataccaatatacacttcactggtagcagaagcagtctgagatttgcaatacccatgccaatgttggaattaggattttaaaaatttctctcagtttgataagcaaatgatggattctcaattttagaatataaaataggaaacagatgcttgtaaaggaatactcatggatcattaaaaatatcaatctaaacagcataacttgtttttagatagaatgacgaggtaatgttaatttcattggctctgccactctcagcctgggaaggctatttgatcttatgctgttgaagacggaatcaaaagctaaatgattttcattcttataaagatagatgatcatgttaattatattaattatagttttcttgagaaagaggttgaggaccctaaggaatgggacaagggagacattctttaatagagttctcaagtttacttacagtggaggtactgctcaacaagtgacatgaggtgcagtagcttttctggaagtgtttggaatgctgtgagcagaaaagaactaagattactctacaaatctaaaagtgaaatgtcatattgtgtgctagctagtgtagatattttataaatttctctcctcaaaatttaaaaaatacatttctatattgatactgtcttttagtctcattttgcaaaatcaaaagttaaaaagaaaatattggatataacttgttgctattttgtatccgtttcttcttcatcctatacactaaccttttatccttcctctaatgcagtcagtacttagcatatatattccatgaagaccctacctccaaccctatcctatcttgctcccaaagagggatcatgttcatcatactgacacctagttctaagggatacattgcttaacacaaggctctcagtgctataagacttcccctgcctttgcaattgcacttgactatattaaagtgttctggtggcattggttgaagcacccgagtttgaaattagattaattcatgctttcttggtgcttagaattcttaaacagatgatttcctatgattttttttgaagagatggagtctccctctgtcacccaggctggagtatagtgacacaatcatggctcactgcagcctcaacccttgggctcaagttgtcctctcatctcagcctcctgattagcttaggagtacaggtgtgtgccaccattcctggctatattttttattttttgtagagactgagtctcgctttgttgcccaggcttgtctcaaactcctggcttaaagcgatcctcctgcttcagcctctgaaggtgctaggattacaggcatgagtcactgtgcctggtcaattacctatgactgaatcattaatatttatctgaaattatttacccaagccctgattttgatccagtgctccagaacagggtggatgttgtgcttcttttctacctggatctagtccttcctcctaattctaatcttttcctctggcttaacctctgatgccctctatacttctagactgctaagctgcttgtggtattccttggtcaagccctctgattttattatctgtaaaatggaaacaaaaataacttatacttcatttcaagattaaatgagatattattatgagtcttaaaaattgtaacttttagtccacttttaagccctctatcaaaatatgctaattactttgattattacatattgtatacttgtatcaaaacaccaccttgtgtctgataaatatgtaaattataataaataaattacattttaatgcaaaaaaagactcttagaacaatgtctggcatatggggattgctaaataaataggagtgtttgttccattgatccttgaaaacaaacaaacaaacaaattctctattaaagtctttttttctagattttacatgtgtaataaattctgacgcttctcttaaaacagaaaataaaatgaatgaggatctttaaattattgttataaaagcttcaaaatatattaatgaaagaagccagaagttatacacacacacacacacacacacacacacacacacacacacacacaaacacatatatatataaaatgtatgatatatataaatttaaaaaatatttcttttatagagatagggcctcactctgttgcccggactggaatggagtggtacaatcatagcttagtataaactcagacttctaagctcaagtgattctcctgcctcagcctcctgagtagctaggactgtggtagcatgcaccagcacacccagctaattttttattttatgccttttatacagacagggtctctctatgttgcccaggctggtcttgatctgacatgaagtgaccctcctgccttggctttccaaagtgatgagattacaggcatgagacactgcacgcagtccaatttatagaattttatactgtattttaaactggccagaaagtaatttctctatgctctgttgagtagtattatatggttcattaaagatgctgttaaactaaacagcatattgcacaattaagcagacttgcacttaaaaaaagtgtagaaaatgctaatactctaatgaaataggaagtggggagaggcggatgttcttaatgtctaaccagtaagcttcagtgctttgagctttccagaatcaagacaaaattttgattagcttcttggtcaacttccagtaccttctcagggagacgctatatttctcttccaacttgcttcatgttgcttcacacatttcttatagacttgttatgcttcatgttatgattgtatctggataggtccattctcccctagcagcccataggctttttaaggagaaactggggcctttacacttatgcgtgctgtctcaatagggccttggaggaaatggacacttaggaaatgcttatataatgaattttaaagacattcattatataacaaacaattataaaattgcaaaacagaatataaacaattgtattacatatgaagactatagagctacatatatgtgcgtatatgtgtgtatgttttaataatcattaatcactgtatcctctctcggccccctatctttctctcttgaaaaaacaaaaaacaaaaaaacaccacagatccaatacttgttctttaagattcttccagtgggtagtatttttgtattcatctttcatggcatcaacaagcctatttcctcaggatgtcaggctgtcaaaatgaaagcaattctggaagcacgtatccccaagattcttcattaggtcatgtgaacaaatgaggagggatagcaagtttgtctgccatcctcacttcaaccccctccccacctctcctcttctaaattatgtcatgagctaattctttgatagtcacgtttttgtccaaaatctaggaaatgattaccattaaaaggaaaaaatacatatttatgatgcatcaaatttcagaaagcttcacaagagaaagtaaattatcctaaggattaaatggtcttttcagtttgaaatgtgattctggaagccttgtatttctccttaaagtagtaaacaaataattggccattctataaatctttccagaatctcaaagtcactttgtatcatatgtaaatctaatcattagaatcctggatatgtttttttaatacaaagatattaatatactatgctaaatgtaggaataaaataaaatgacaaaataatcacctttttcataagttttctaagtttcccaaattaaacctaataattattgcagcttcaaatgtctttggggtgattattgtttaaagtcctccctttttttttcatgtgggaaaagaatgctctagctcattctttattccttaattaaatgtagtatcaaatggctgcaaaagacaaccactggctatgttttcatacaaaccccatgcttatgaaatcagttctgtggatttaattcactgaccagctaatctttattcttttcctaaattcatctgtaaaaaagaatcccattccaaagaataacacagctgatctctttgcagcccatttatgtcattaaaaagtattataacctaaatataggccttatatcttattagggtagtttggaagatttaaaaataaaattaatgaatttctttattatgtaagaaattctttatattctacttattgcagaataagaactgcatagtagtacaagggataaactctcttgttcctctataaatcaacgtgagacttgttaagcttcatcagttattcacctgagaatagaaaagtatccattgtgtattagaaaaaggaatatgacatacaatacacacatgtgatagatagataaatggatagtcatgatggtttcaaataattttgccaatgcacaatacaagggctttacttttaggaatgccttctgagtcattcatgttgaagagggtaaaattatgtgccttttctgaactaaactctcccagttattaataatataaaaatgttagttgaaaaatcatttgccataacaaaccgacatggattaggtttcattccatattattcagtgtcttacggttatcaactttgtgttgctttacagtcttcattttctttctttcgaccatttcaaatctaattagtgaagagttgagtaaagaaaacactgaatgcattatatgagtacatctgtgtctatcttctttctctctctcatttatctaaagttttatacctgccaaagtttgtagttcaaaactagagcaagtgatcacttagtacattactttttgaatattaataagtgtattagtccattttcacactgctatgaagaactttcctgaagttgggtaatttataaggaaaagaggtttaattgacttacagttctgcatggctggggaggccccaggaaacacaatcatggtgcaagcggaagcaggcactttcttcaccttcttcacaaggtggcaggagggagtatgtgcgagcacgatgaagtgcctcactttaaaaccatcagctcttatgagaactcactcactatcatgaaaacagcatgggagaaaccgcgcccatgattcaatgacctcccacctggtccctcccctgacatgtggagattaaaatttgaggtaagatttgggtggggacacagaggcaaaccatatcagtaggtatttggaactttaagtactattgtcttcattttatgaatcgagaaacttagtcattaaaccagaaacaatttttatttttatttcatttatttatgtagagacagagtcttattctgtcacccaggctaaagtacagtagtgtgatcatggctcactgcagccttaacctacccagctcaagtgatccttcttgccttagactcctgagtagctggggccacaggtgcacaccactatgccaagctaaattttttttcttttattttttgcaaagatggggtctcattatgttgcctaggctggtctcaagctcctgggctcacgcaatcctcccacctcagcctctcaaagtgctgagattacaggcgtgagccactgcacctggcccggatagaatgtttataaacagagtattcctctgtgaagtatgttagttcttagaaatacagaaaagtctcttatggaataacagtaagtagaaaaatacacatttatctaaatgtaactacttgcctatgatatacatcatttagtgatggcttaaactataagatattgatcttcagaatgataaagagagtgggcttgatgtcatttgcttaaagatgcttcacctagaatgaatatactttttccaccttttcctcaaaactattgccttctattagtgttctgtcagaagtagctctctggtacaatactaaggtgcaagtataagctgatctactttttaaaaaacagctacggtggcatctttaaggggttttaagtcagccataaggagtattagaccaatagaggagaatcagttaaacaacaggaataaaaaaagggaagggttaaggaacttaccgaaaataaaggtataggaatttcttcctttaaaatttatttaaattttggaaatatggggtaaaaatgagtcagtgagcaggacgtttaacttgacaggcaactttatagttgcaaaccattttaaatttcacttcgactttccattatcccttagagactcgaagacctaatttagactgtctggctacactatcacagggggatgatttgtgcacttagggtatcccttggggttttctacctgtttggaaattaagatgtaaattagtattgtagtatgttagaggggtgtactggcaggcagttaatttccttaggtgaaattaatgctcagagagaaatcgtacttacatattcaggttaggctattacataggcacttcaatggagtgaaattaccttttcttctatttcatacaagtgttgtacaacacaaaaattacataatcttccatgttaataattactaatgtcaccttaaaatattgtatgctattgaatgattatgcatttactggaaatgtataccccacagggtatttaccaagtttctctatcaggcatcatcctccctcttccgccatacctggaactgctgtgttcctctttcactgtagggactaagtagatatgtattaatttttggattttcttatatttagatagtttttgaaaattttctttttggtgatcactgaagttctctgttagagacctagtggcaaaagttattttaactttgtgcttagaaaataaggacactcttcacttttacataaatataaagaggatgcaaacatcaagtacttcattaattaacaagaaaacttttagaaatatcatgtgttttgtcaccacaatgtgtggcacaatgccagcagatggcataaaaagtgtttgaaacgtgatgtgatttggttttgctttcagaaaactaaacagtttctctttggattgagcatagtatcttcttcatgtacatgtcatggattgcttagatagtttttacaagttcgttatctatctcgtaaagcccacattattgtagtttttgatacgtatctctttatttcatcattttgacatagccataaatggtatcccacatagatattcaaacaatgtaccattaactaggacatagaaatcctagtcattagctaacatgaccccacgtggaaatacaccactttatggagtggaagggcaagggaagcagatgggggaagaagtatgctcaaaaaatagaaaagtatatacaaagaaatacaagccatgaggtgaatgataaccaaacagattttttttttaaataagagaaaaaacaaaaagtaaaacagcctagatgataacacatttttgcctggtccagcctttgggaaaccagattacattctttcatctcatagtttcatgggcatgtatttttaccagggaaagagaatttgtacatgataatatttctaaatcatactctaaatcattctctgtactttcagaattaaatcttggcacacatgtagtaagcctacatgagaaggtgcagttccaatacaactgagtggttattattaaatcaagtagtgaagatccagttgtagttcatttgagagcaagattctgtgaatgctttaaatgtattaacagtggttactttgctctgcaatggcttacagtcaagagaggggaaaactaatgcatataaatattaatacatgatgatacaatcaaatactaagcacagatataactttgtagagtgacctagagaagatataattgattttgaagggctgaattttttaaaagggatcttcagctgggtttataggtaaatagaatttatatagccacaatagagagttagaggtacagaaagaaggacatttcttgaaaggggtctatggaaaccaaagcacgcataagggaatgaggactcagaagttgagaaacctgaacagagggtgcgggacagttttactttggatctgtattctgcctcttcttttcttccttctttcttagtcttccactttttttccctacaaatatttgttgaattacttgtatgtgtatctgttctttaactgtaagcagaaacccagttcatcatgagatttttcattctctcttcatgcacacagaatagttacatagatatatactgctgtgaatgtctgtttcaaaagctcactttaatgaaagtctgtttttgtcgtaggttttatgaaaagaaaaaaataaacattgatatctgaacacatgggaactagatgttccaactcaccctcttgatgtctgtaattattttattttggcactaatattaccaagcttgtttataattaaagataaatgaaatagtaaaattaactactttatctccttatttaaatttcagatgggaaatttggaattttactgtttaagtcctttgttaaatatctaaaagggctctactacagggagacggattaattaaaatcaaaattgttgagggaatataattaaaaacaaaatcttataccaacccagaaatcccctccaccaaagtaatagaaaaagaaaacacttttactattaagcattaaaccagaatgtgatgaacattacaggcaatccactaagattataaaaaccaaaagaaatctcacttttctatattgccaagtagatgtagccaagagtgggattacacacatgctttcaagataaacaacaaccagtcctcaagtaaaaggacttgacagccccatcctaaattcttcaggtaattggggtgatcatctgtgttagctaattggctttctctgaggagaaacaaatttctcatccctttatgacaggaagaagttttgcaacttggagcaagggtaaccctgaagttaggctcctaccctcccataggaactgggagataggggagctttctcccttgatgtttgcatttcaaaaagatagcctcaaggttcttgagaaagcatttctgagttgtgaggctaatgggaggcttagttagccatcattaagatttacataaattctcaaagaacaaagaaagaaattctaaaagaaaagggagggtagaaagcagtctctatctacccttgttttcagcagagagatttgaataagaggtatatttgtccttacagtgtaaaatgaaggaaataattgttttttaagaaaagtagtcagtggatattttgggttacctgagtatattgtcagtatattctaaaacaaataacaaataggccttaaaatggaaagattgaagtaagatgatcactactccttcacactcatagtaacttgattgttgggtaaattattggagggtagttctgctcatatttggcttttgcaagggaaggcagaccttgtggagagcagaatggatcatataaaaaaggtcttaaatttctacttgaaatgtgtttcagactggacatcctagctttctggtgcatttaacttaaactgctcaactactcattcagtgctcattcaaatgttaatgtgggccatctgcctccccatccccatccttttttatagcaggaacaagctgaaggtcacatgaccctaattactgcaattatgagatttctgggagtaatcacttaggttgcacccagagtgagcatctgctgatgataaatagatcaggagattactaaagacaggcttccctataagatatccagtgattaatttcttaatatatatacatatgcacagctaaatccatatgctctaataaaagcattcttttcctcacactttttcctaaaatgcctctttaaaatttagtaggaacagcataaaatgcatatttttttgtgtgcgaatgtaattagaattctaaagagggaatagggaagatattctaataatgactaataatgaagcagcagcctttacctacacaaattttagttctctgtgcaaggagaaaagaatgtcacaagggcttaatctttccagcagaaatattatttcatattattttattttgttttgtttttattaattttgagatgaagacctaatttctaatgaaaagggtgtgtgtttaagggaagattcttcaggccgcttaagaccttctgaggcccattccttagcaagatgaattcttttccctttcatgaggtcatttgcttattaaaaggtggttgtttcataggatattttctcacagtattgtttactttgctccctattatattttgcttactataaagcacttacagttttaaattctattgtgtattaatttgacttatttttagcctctcccatctcatgcagtaatttttgaatgacacactgtgctaaatatcatgttaggagatgtggcagtatttttgcaataccattggttggtctccccatgttggttaatgacaatgacattaaaggttatgcatagtatctttcttcttttgaaaatctctccttttgccaatttgcccccaaagtatggtttagagcttcttataatttcctttatagtattgaggcaggctaagcttatttccagtatgtgtaaaatgactctaaatgaataatttattcactaaacaaatgctttcttgagcaccacatcgtgccaagaagtgtgctagaaaagaacaagaaagacacagtcttgctcacttttattcaggtggcagcagccttctacgtacatacatgtactttacaacacactaatatgatgcaccaaaatataatgtatcatttcctaaatgatttgacctcatttattaataatttcaaaatacatcaattgatggtttttaaaagtcgttttgtggcagcacctgtccaatccttcctcccccaccccctcttttgtcattactaggatatgattcaacttattcttcaggcataaaggagtttgattggattgtaacccttttctctcctttttatctgtgtttatgcttccttccttgcttcttgtaaactctttaatcttatttaaaaaaaaaaaattttttaggttgttaggactgatatctttctcttctaacttttcagagaaagaacagttaagagactttgcaatattggaactctgtcagctgggcccctatgcctctcaaagataacatcaaaagcacattcatgatccatctgagctgatataccaggagattgggattttgtgatcaataacacattatatggtccattctatagcatgttttaaaggagaaactgtttgctaaattccttaattgttgttttcataggtactaaagctcctatggtattattttttcaataaaattataaatacatagcagtgtagttcagttcagttttgtaagacttcatattaattaaatcataaattacacagaaaaatcttttgacaagccatatttttagagctttggttcagaaagtattgttttcataaataaaattcaaatgagggagaatttgttcattcacttttaaagaagcatcaaagacctgtgtcgagctgcttctcatactggatatagaacaagagtcagcatcatttaaaccagtgccccattaggattgatgggcctccttttttttttccaccagctagatctcagctgtgaaatgagaaaaatatattcagtaaagacagtaatataaattccaaggagctaatcagattagaaagccatggccatacacttctgaatcaaggcagagccctgtaaatatggctaatgcaaaaccaatggcacctgtcacaaaacagcattttgaactctaaaaactagagtatcatagatgcaggaaaataaaatgatttggaagaagtcttgcaggttgggataagagagacctaaatcatattgaagtagttgacaagtcataaacctcaggttgaggaaaatattgccccttcttatatgatgtttcaagaaatgtttgtgacaaataatttttaaaaataacttttgaaagtgctgtataatcaagcattgtatttctgattgagagttcaaatccatatatgaaaaaagtttcaaaataattaatatatgtaagaggcctgcacttgtaggtctctgcagttgtaaggacgtggcctaagacctcaatccaggaaatttatttaaagctccatatggaagtttttgtttttgtttttgtttatttacctttggtaaaatcttaaattttcttcattcagggaaagtatcagttgatgctgctccctcagtaacaaaacggttgcattcaaactgttacaacttacatagaaaacccagagcactgaatcaaagagatgtcaactaactcattgaagcccacaattattggtggtggagtaagtgtagttgtgactctaataaatttacagttgtcttttcctgtttatggttgccaatattggtctttagatatgatgtattacatacttaaaaacctggtaagggacaaattaaaatctgacatttgcattcagcttaaattagttaagtcagtaaatggttcttcagccttatttcctgccatctctcctccttttattctccatgtttttttctgttaggagtgaatgcttagacctcagttactcagagccgtctttcctacagtgggcgagatgccctcactgtgcactcccataacaccccgaatgcaatctctcatggcatttcgctttattctccctccctaatcaacatgttttaaagattaattagattcctagttgttgaagtcagagaccacacatggcttgtcattactgtctttctggaacttagtgcgttgcttgatataattttagtgtttatgatgttgcccacattcactcttactctcattgctgttgttggattgctgttactattccagcgccctgtgtgcccttctctattgctgtcctgagtattccctttctaaccaccctgtctgagctcctcagcctacgtcttctgcatgctggaggctggacccaaatgctaggcccttctcttgcccatctcttccagcctgcaggagctgctgcttctccactggaggctcctgtcgtaattcagcagtcaaactgcaatatttacttttaaggagcttgacaggtaaaaagaaatctcttcaaactgcatgagacctattcagctccatttggctttttattcatttatttttctcttgccaggtggtccgaatcaaagattgaagtgccctagatttccaaatttgtcttttatatattcagtgttaagtgcttagtgttgtttataatttaaacataacttttataaaactctattttgaaaagcgatgactaactatggatatacataaaaaggatgttagcagaaatgaaaagttccgtttaagtccttcttaaggcttgtctcatttagacaaacaaaagttacattgtttgcctgctcactgatgactggtaccatttttacttcccccatttgctaaatactcaaaatttatttgagcttttttttttattaaatgcagcgaaacaatttagtgcatcaaaaactacatattgtggtatgagtaaatgttgtttcacagcttattttagcattctagaaaggttggcatggaaaccttgagaaggcattttagatgctcagtgatgcataaaggcattcattttgaaagtcctgtttatcttatttatcccaatttagaatcaattttaatagttatttgtatctaattttagaaatatgatttttttcaacaggcagaagtagtttctttagtctttttcttttttttcttttttttatttttaacacacataatccagagtcagggagagttttcaacaattaagcaatataattcactggatagagatatacattggaatcatttagatttggtttcaaatgctggctgttagctttatgataattgctatgttagtagcctcgaaacatgagattaaacattaagataatagcaataaaaggaaataaataaggtaatacatgcaatacactatacaatataatatgttaccaggtaatatatgtaacacacttgcataaagtatacattcatcaactttcattattatatgtgtaaaataatagagctggaaaaagaaaaattcaataaattactttgactcaggaaccttttcatcattcatcctcttttcagtctttctgtcttgcctgaacactgggaaatgttggttcaattgaatcacaagacattcactaatttatttatgaataagcttctatggattacaaagggtgtgaaaaaagttaatatcaatttttttttcaattcattacctgttgtgtttgttatttggttgttggtggatctctcttaccccatgataattagggaccatcagtgtcccttgggatccagagacctggtttcaatttttgtctcgtctgctaagcagctgtgttaccttgaataaggaaattcaaatcttgagacctgggttttcttgtatataaattaaatggagatgagccgtattatttttaatatacgttctagcttttatccatatttttccagtaggatattagaaattaaataaagactattctgtatctaccatctctgtagacatgctcagaggttgtcaaacattttggaaatgacttttgttaagtgaattagctactaatttttttaaaacttagagtcacaaaacaactagcaaataaatgacaattatttctaaatttgtttttaatatagagattaatttttcatatctatatttagaaatgacgtcttctaattttatctaggcataaaacagctaaaaaacttgatatagtctataccaaaataacccaataataaaagtaagttgtaatgggagaataacccaaaggagcaattttcatgtgaaaaattttccagtgtatgaagaattgttattcacggaaggctaatctgttggcaatgtctgttgctgagctgaagagggttctgacaaagcaagcccattcctgcatggactaagccttcgagtggccttgaattagaaaggaagataattctgcctctggaaaaagatatcatagtgtagttatatagaaattactcctcaaaagttccaacccttctaactaaagctttaccaaaagaatcccaaagaagataaactttcaaaattccgctaaataaaaactccattgtcctttcaaaaaacatatacattctcagggaattttgtatagttcaagattatataaataactttgtccaaactcttagtttctacatttctttagaatttctctttttctcctaagaaagtctggggaaaaaactcttcactatagtaactgattagttccatttcctgtcatatttcttttcttgtggttgctggtttctagccaattctatttttgcatttattttcccccattacattctgtttcttttttttctgggtagaagaatttttgtgtttttcattttgtcaaaatggaattcttctcatgttatgtcatgattttgatattttcaagcttaaaaagcaacacagaggaggtttgtttacataatgaagcatatcatgggctttttacagaaggtctgataattcagaaagtattttcaactagcagtggattagcaatgcctacttttttcataagtcctattcttttgagcatagtcagcttgaggcagctgtggtttaaaagaggaaactaggagtctaggaagtgacctcatgaaaatgcagaaaattaagagtttaaatagtaataatatacaaaagcaaatagcatatttcactaaatgtctgagtgcctgagaattctggaagtggagggaaatccaatttaaagaatataaaattaatatccacatgtgagtacatagagagaaatacagaagggggaggctgagagacctttctcaggctttcgttttttggtttgtttctttatttttttctttcttttttttttaaagagcactctagatttatttgggtaaaatacgtgagtatttgcttaggatatatgcatttataaatttaaaagagcaaggattctccctggggcaaatctttccttggatcattgaaaactaaccaaacagtgtcttctaactagattatcttcatactagatccttgcagaagtattagctgacctaagtcctattttttgccaccctgaaagtgaaagaaggaagtgctgctataataagaactgtaactaaatctaacggcatccctgttttctgatgatggtcatgtgttagaaaagtttcatttcatacctgagatataagatgtacaaatgtctttcctaagcttgatcatccatggcagatctatgatggaatatagtggggaatctgtaaagctgactgactacaaaaccaacaaatactttttcttctctcccagatttacttaattaaaccaggagacttgtgaatatatgaataggacagagctccaggcagatggacttttatgaattctgcaccctcactatctggagctctttatactaatcctggcatctgggagaaaagtgattgcaaagttacacattagaattgtctcattttcttgtggcagttcttagtgtgatatctggtggacatcgttcctgtatcaccctgtgtagaaataaaaaagaacacttaatcctcacttactctaccctgtatttttctccatagcatttctatattactgatatatctgatatatttttttgtacaattaattattgtttcacctaactagaatgttcatagagcaggaacattttctgttttgatcactgatgagtccctaacatctagccaagtttttggcacatcatagttgctcaataatatctgttcaatgaatatgaatttagtcactattttcacgcatacaccgatgcctactgttgtctggtcttcccctcgcagccgtgtactccgcctctcttctttctcaccacatcccacaattcccatcccactagcagctttcttcacaacaatgaggttacatacttgattaaggaaccatctcttatggatctttctcaggtgcttagtgtgacaccatgtgtggctgtgccctcttagaggtgagagctgagctcctgatttggcttctttatgcccttccttcatgaaggacagtggttctcagagtgtcccctgaaccagcaccatcagcatcacatgggtacttgttagaaatgtaaatctttgggctccaccccagacctagtgaatcagaaatgtgtggctgcagctcggtaacctgcgttttgtcaagtcttccaagtaattctgatgctgaagtttgagaaccagtgagaagacatagattgcctcctggctttgtttttaacttttcaaaatccctgtaatttctctgggcatatttcttcaggagatccaaaaagattcatattatacgaagttctctctctaaattaatgcaggggcttaacatttatttattaaattatgggcatggtaggcatagattatatgtccctgtagaatcttgcaaggtagaagccatcttccccccctgcccaccccagaaaatatgcaaattcaagtttctagaagactgggctgtaattcccatttatttttaagtgtatacctacctccttcatccccccaaacttcccacatggtatatgtataaattcaaccctagaacctgttgtaggtgagccacagctcttcaggacaaatactcaaaatcagtaattgtatgtaaagctaaaaattaaacttctttagaatgggaaatattacgtagatattatatagtcttctttcttggaaattctatgtaattctgttttagagaaagataggaatggttcctcactttaaaatttttatgtactaaatctgctttaatttataaaatagcaatataatgttatatttgcttttttattaaaaccacttctgtcatttatgggaaaatatttcagttgccacatttcattcttaacttgattataatttggttaacatattgacagttcagccttttgaatgcttgacttctagtccccagacctttcactgtagctgaaagagcatcagaacttgggttctttctcaaaagaggacctggaagaatagctgagcccatgtcatcttaggactatatatatatacatgtatatgtacataaatatacatgtatatatgtacatatgtatgtatatatgtatatgtacatatgtatgtatatatgtacatgtacatatgtatgtatatatgtatatgtacatatgtatgtatatatatgtgtgtgtgtatatgtgtgtgtatatgtatatatgtgtgtatatacatatatatacacacatatatacacacatacatatatatacatacatatgtacatatacatatatcctcaatcattttttcacattttaaaaagcctaatcacatatctagcctttttctctggggaagaccaattcattatagttccttaagaactttgagtctgaactaagaataaggaggtgctatttgtctctcaaatggagtttgctatagtacacattagaactgacaaggattttagttaggaaaaaaaatggtggtgtggatgaagcagcaacagttatcaaatgtggtggagaggacactaaagcttccttgcttgcaatgttagagcaacaagggcattccattttgaaaggaagtaagcaagtttaggaagacaaactctattgttgtcaagattataaattagcaaggcattcagtcaaaaccgacttatagttaatgcattgtacgtcaattaacatgaataagtaaacttcttaacaaacaactgtatgtgtgatttgatgaagagatggtaactgaacctgtcagatgaggaacattgctgggtgtaagtgagaaaagcatatatctcctatggaaatcatcgatgttactgtttagtccattaaagcaactcttcaagaaaaaatatatgggtctgattatcacaaatgttacttattaacatatccagtcttataatgacaccaggtctcctaaaatccctttataattattctaaaaatagaattcaatctaaaataagtgggaggcaagcagattcatcattcactaaagggcatcagcaagatgaaaaatggtccatagagaagcaataaatactttgagcaaatacatatgtcactaagtacctataagctatttatttctcattttagccataacctttaattgtactcccatctgtcctagaccaattactcacgtcttgactgctgaagtcatttgttatagcccaacattttgttctttcttttctttcttcttccccacccgcccgcccattaatgattgtagaggagaaacaaactcaataattctatgagtattgagagcagagttttccttaggtatatttaattttgaccacatggggaagaattacaaaaaatttaaaataacagtaacttaagccaactcaagtttaacatagtgctccattatcatcagggacccagatgctctctgtatttttgccctgctgtcctcaacatgcaacttccattttgtttccaagatggctgcttctgcccccactgtcttatcacatatgcatcccagatagcaggagggagaaatgcagagatgggcatgacctctccctttacacacatttctgactagtcacatatacttcttgttctcacatcccaccagaccttagttatttcatcgtactttgctatatagatgatatgtagtcattattaaaaataaacatgtgcccaactaacatttgaggattcttttacttaagaagaaggagagaattgataatgaaggacagtttttggcttctgctgcatgagaattagccctatttattttgttaatcagaggaggaagtacagattattagggttgcagtgaatgttcactgttcagttacatgattataggacaaatatagacaggaaattaaaatctcttgcagattatttaatttgagattttaaagttgtctgctattcatgaggatgtgtatttttctcagcttgaattaaatcataaattctagtaatttgtatttataagagaacaaatatttatgaagttcctggcagcatacaaggttcttgatatatattttcatttttttctttataagcatccagtaatagaggtattcaccttttttatggttgaagagtctgagaattagaattgattaatttgctccaggtcacatagataataacaaatagggttgaattttgacccatgtctgttgggttgcaaaatgtgtcttttctcccatattgttctgtttcctagttgcttctcagtatttattagcacagtattcaatttgtttcattcatctttagatcctccatgttacaaacagtatatttagctgctgattgaatgaatgaaatacaaatacaaagtccactattttcgccaatgctgtgaaatgtttttatcatttgtagactatttaaagccatctcatgcctttgctatgtttaatttctgattagtggccaacatttttattgagcaaattcagtgacatgatagatgggatattccaaatagtattttttcttcataagaaaaaagaaagagaaaaagaaatgaaagaggaaagaaaagataatgtccttctctttatttctaagttcttattgcacctgactgtcctcatgttgtgggcttgttttgtctgtattccatgtcgtcaaatatctactctttatcatgcagaaatttttcctcattatttaatagcatagccttctaaagccatttaatttgagaaagcatgtgtaatgccatttagtggttattacatttgattgctagagtagagaaaatacaaacactttttttatgagcctgaatcagactttcataaaacaagttataaaataattaaatgtgtgtttgccaaatttatgcatgtcaactttgagaataatgagtcagaagttgaggaaaatttaccttcaatacccttgagttatttaatctttggctaatatgacttatttgtctgtgtactttacaatagttttagaaatctgttatgttaattgaattttgaaattcaaataatgatgtttgtaatatatagattgctgatataagctacttttacaggcaattcctctttctatttttaatgtgaaatttaagtgagcttaattattcaggtacaaatggtattgggcattgaccaaattagggtgctcttatgcaaccaatcttagactcctaagggaaggatcttattgagaaaaggtgtctttaaataatgttttctaaaatactataatataaatgttgatttgtttcctcactttgactaactagaaaataggacttcagctaggcatggtggctcacgcctgaaatcccagcactctgggaggctgaggtggcaggattgcgtgagtccaagattttgagaccagcttgggcaatatagtgagacctcatctctacaaaaactaaaaaaattagctaggcatggtagctgtgtttgtagtcccaactactcaggaggctgaagcaggaggatcacttgagtctgggaggtggaggctgcagtgagctgtgatagcatcactacacaccagcctaggtgacagagggagagccagtctcaggaaaaaaaaaaaaaaaaaagaagagaaggaggaagaaaaaaatgaaaatgaaaagaggacttcagctcttatatgttctaggatctatttatttcacataaactcttcttcatcatcctcattttctttatcacatgcctaatgctaagtgttaagcccttaccatgtgttatttcattgaatcctttagcagttccaaaaactaggtaatattgttatccctattttaaagatgatgtaactgagattgagtcaagttaaacaatttccccagggtctcatagcttacagctggctgggactggattcaagttgagacagtctgaaatccagtgcctgccctctaaagtatactatgatgcctatgtgcctaatctcacagattcctaaatgtggaactggccgtgtttcgatgaccctgcctttagtgttgtcccactaagtctctctctccttttaaagctggcctcttagaactcaagaccacaaaataacctcctgttcctctgcacagaaatcaatgtggactagttgtacaggctatttgcatttcccattttgatttaattggttgattattttaattagccaacaaatttgatgaatttttcaccagtgaactcagtggtgattttcatgtatcttaaaaactaggcttagcctgctctctggtgaactcatgaaatagctgggatttgcccactcctccctgctcccctgacagaagcattctccctttcagaccttttcttttttcttcaagtggtccgcactgcatttcccctttgtaccacttcaaaaccaagccttgaaaaataagtgcgattttactttctcattattcttctctactgcccccatttcccaagccaaggtatgtttttattatttttattttataatttatttttattttttatttttgagatggggtttcgctcatcacccaggctggagtgcaatggcatggtctcagctcactgcaacctccgcctcccaggttcaagcgattctcctgcctgagcctcccaagtagctgggattacaggcacccaccaccacatctggctaatttttgtatttttagtaaagatggggtttcaccctgttggccaggctggtctcgaattcctgacctcaggtgatccgcctgccttggcctcccaaaatgctgggattacaggcaagccatgtttttaaatattgttttttctggtttcctaattgctctgttttcagtacaaacattttagaaagtacagaacagtgtaaagaaacagaaagaaatacagatcccgtgattctacatccagatgcagctacagtatgcattttggcaaatttcctttcagccttttgttgtatgaaaaatttctaagacatgaggatttattttttaataggatacagctctttgaaacaaaagccatgtttatgctcaaggcatacttatgcttctggttcagatatacagaattgtctcgttctagggattcagtgaggatctaaatctgtttgtgttagggacatcgatgtgatgccaccctcaaagaggacaggagaggtgcttgaagatcaaaaccattcctgggagaactaggttgagacaggggtaaggggagccggtctaggtaagagagttgacaaagcaaaagataggtctttccatgaattttattaacacaaggagagtgagagcagggaccacacccagttggagggaatgggagttgagtgctggctgaaggaactagggcatcccaagagacctggcttcaaagggccgtccagcagcctggctaccccaaagggctatgcaaaataccaagacctgccaaagtgctcagaacctccaccttcaagcatagaccaacttgattattcctgagccctgcaagtaattgatgtgagaccttttgttagtttgccattaataacagccaacatttcttgagtatgtgtccagcactggctaatctatctcctggtgttatcttgtttagcccttacaacaagttggttactgttgggatatccattttacagataaagagtcagagttaagagaagttgatggttttgcccaaggccacttggataaatagagaaataggaattccagctcagtgattgtctcattctagttcttactcttcgctgccatgtggtctgtgatttagtcatttgccagggggttatggtagtagtctaacctactggaggaaactgttgtgtacgggggtgggtgggaggcagtaatttctggaggttttcaaattattgtaccaaggtagcattgcttaccccttctaaattgctctgtgtaaacctggtctataaatatgtcaaatattcaaactaacttctgacttagaagtattccaagctcttgagtctgtcaacattttttcttttaattaagctggacttcagttttattcacatagaacatagaattatataatcagaatatctcaattgtcacaatttctacaagagttacaattcaaaatttaactgaatcactgctctgaaatagcaggagttttaaagttagtctgcaaggacatgaagaaatactcatgaaacatgaaatttcaaggtcatgtaccctgcctgccatcatcccaaaaatggaatacgtgcattttttaacagctttattgggatataattcatataccatataattcactcatttgaattataaaatccagtggtttttagtatattaacagatatgtgcaccattgccacagtcaattttagaatattttcattacttcagaaagaaatcccatagtgtcctctggctactacctccccaccctttcatgtcctcccttctcctctctcccaccccagtctgaagcaactagtaatctactttctgtctctatagatttgtctattctggatatttatataaatggaatgatataatatgtgaacattggtgactggattctttcagctaacgtgttttcaagattcatccaagttgtgtcatgtgctcaatttgttctttgtattttattttttctaagggttcacacccttgatgccgataacaggtgcttccctacttatcctggacaacttcaccgcataaccataacatttccaaggatcacttagaattataaattttgcacattgtggtagacaggtctttgatccctgcaaagctttaagaacacttttcactacttcagagatgtccatgttctccttagcatcttttcgtctctcataaatatattttcagccatgaatgcatggttcagtgaagccttcccttgcagtctggcaaagtgtcttttttttttttttctgcagaagaaagctgatcaatggctgtgaaataaaagtaagctttaaaacaaacaattagaaaacagtagggtcaatccattttgaggaggtttgtagttttagactccattaataaattacaaagccagaattaaacttgtaataaataatactatgttgtaggtatttttcgaggtttatttttcagttacaccaaattaaatataatcatttgattaaaataatacaaaagccaatataatataaaattttatttatcatttgctgttcctcattgtcttctcctataagctgacctcttatataatatagtaactgaattggtattaaataggtctttgctccattcattgtagcttactgaataattatacaaatatttcataatacagttgtaaacctagaatgaattttatactaagaaacagaaagttaggttcttcaaaactttcttagaatgagacagattatggatacaaataaaataaaataaattggtattttaactattatgctttttatttcagcactatctcagagtgagacagcatttgtttaaatgtttgttaaatgtttattctcctaaacatttaataacctgatctgtgccataagctggactaggtgttttcaagtatatttcagttatttatgacatatgcaaatataaaataataagcaaaatgatgtaacactgtcatattattattattgttccagctatcagtatagtgcctaccaaagactgtacagatttatctctatgcttcattttgggcttgagcccaggtagagagaaaggtaaattttgctcagaaatgtatactgttacccagcttctttatactacaaatagcttgaaagaaaaaaagttttcttgactcttgttcagtcacagcagtcttccaaacaaaatgttgtttgttgaccttggaactgccctccacacaccacgcaactctttgtcagtcaagtgagagctgtttattgggtgctgtggaatccagcagcttctcacatggttccagagtccggtgaacagaagccttgtctgtgtcttgggtgatggtgagacaagacatggtggatccccaactatgattttaactaatagaatatgaagctatttcagagcctcactttgtgtcttaaattgagttacttgttaatctaaagaaattttaaaatatgatagtattttttttcataaacctgtgaaatgtctaagcactaagtggtcagacagaacataaatttaggtttatccaggacagaagttttcatcttcaccctttgtttcaatttccatcctattgggttgcatcgaaccagtgtttcctcactgaatatgttcattatgtgtgtacatactgtaaggatagctcacagtggcgggacatgtgttttataggatttttttctaagtggcccaagagtatacaggcatacctaattttgttgtgctttgctttattgtttttgctttattgtgcttcacagataatgcatgttttagacattgaaggtctgtggcacacttatattaagcaagtctgtcagcaccattttttcaacagcataagctcactttgtgtctctgtgtcacattttggtaattctcacgatatttcaaacttttaaattattttttgtatctgttatggtgatctgtgatcagtgatctttgatgttactatagtaattattttgagacccccaaaactacaagaatcactgaaagaaacacacaataaattttccatataagttgaattaatttatacctggataggtttatgtgcaaatcaataaggcaactagcataattaagaaaaaaattaaaaattcagtttctgtactgagactacatttaggtaaaatggttaaatgcaccagaaactttcatccaatcctaatgaaagataaattgtatgattttctggataatgcaattaattagaagctaattacaggtatatgtgtatattgtacactctttctgtacatacacaagttttgtttacatgattgtattacagccttcatcatcatttagcacagtattgagaaactagtagccattcttttaatatttggtttgtaatcaagtcaagtcattttaaaggtctgacatagtcatggggtgattctaataaatcctggacttagagtgaagactctctcactgatattcttgtaattatttccttaatcctcctcagattcagcctttaattcattttatcaagaagcagcattgctatgttaatttcctttatagtctgttgctcataagaagcattaataagcacagaaataataataatatcaacaatatttgatgtttggcacctgtaccaaatacaatgcatgtgactattgctgatcttcagataggtaatagtatctagctcaccaagattaagtaacttgcccagagtcacagtcaggcagattgaacccagtctatctcacttgagcatcactgtagaatattttgatcatacatgcacaccatctttggctgtgtcttcacgcagaaatctgttggttattttttgctgaggagactttgaatttttggatttgtgcctatgaatattatctctgttaaatactttacaaatggttaatacaatttatgatataatgaaataaatgaactggaacttgaaaataatatttagagaagagagagaaatgggagagtaggttaatattttagattcatgaactttgtggtgactgacttttaaggttaaaagagttagtgaatttttgctattttatatcattggttcatattccatatttatatcatttgttcaagttcctcaaatgttttttagcaaaataataatgatgaagtgaggttaatgtctgctatttttttttcatcaagttgaaacaagacaaaactcaagaaatcagcaggtcagagcaaacggacagaagagtccttttttttttttttttttcctctgtgtatgactctgggtataaatagaacagtaataaattggttttggaaaaatgtggtacacattggaaaagatgaaggctagcgcctggtacactttggattaaaatacgtatcaaacttccatattatccccttctgcctctgcagttaataaaaacacatcgtgaaatcgagatgctgaaaaaaacaagcatttctttcctaacattgatgacactgatttaataaaatctgtcgctgaataccctaaagtttgttcaatgagaaggatgtgaattaattaatttaaatatatatagattagagtagctaacaaataatatcattgttgcttttaagttagggaaaaataaccagtggtttccatcttgtcttttagaatctagtacagattactagttttattaacttttaattaaacactaatacagtaactggtttttcaaaaaatattagaatgatacacatcttttctgtgtgatcttgatatttaaggcagaacacaatatcatttccttaatttatgatatgctggactaacattttaattttttctttaaaccttgtgtttatttgacctgctgatcctgcaattgtccagaatcattatcactttggagattatttttaaagttaccttaaaatatgcagattgtttctgctcttataaaatgccaagtataaagaccaaagtaaataacttattaaatattaatggaattgcatttctgtaattgttgtgaatgcattctgtatgtagtgaattgttgggtctaattaattatatatttacctctgctccttcacaatttggccactcttttgacctaatttatgacatgagtcagaacagctgaagtagtcatttaacgcaactagtattttctgaagaaaacaatgaataatctctatgctgagtatctatctaaagtctaggaaaacaaagtcaatttggccaatttcactgagatgctcatttgagtatgttcctaaatgactattctctaaagaataactgaaaactagtgcttaatttttaggagcaaagacttcatgggttgtcttttattataattatcacttgaattaatgttataatctaattatatttacacttactagtaaatatgaatttttaaaattaacaatctgctttttttttatgtctgtgatgatggaatagtgcaaatttgttgttgacaaactcatgtaagactcatttgttttttggctcaaaccacataaaagtcactttcgtgctggctgcagtggctcgtgcctataatcccagcactttgggagaccaaggcaggaggattgcttgaggctaggagttcaagaacagcctgggtaacatagtgagaccccatctcacgaaaaaaaaaaaaaaaaaatagccaggcttggtggcatgtgcctgtagtcccagctactcaggaggccaaggcaggagggttgtttgagcctgggaggtcgaggctgcagtgagctgtgatcatgccagtacactcgagactgggtgacagagggagacgttgtaaaaaaaaaaaaaaaaaaaaaaaaaagccacaaagtttacaatagtggatttggcccagaatctgttattgtgagcttgaatttagataaaatagaaatatatagtgaccactttctttccataattataggtctgaggaatagttagatgacattttaagaaaagtaaaaaaggtaaatttaatgttttagcatttgtataatgcatttctggatattgtctccattaaaaaattaatgaaaatcacagcactggccgggcgcggtcgctcacacctgtaatcccagcactttggaaggcccaggcaggcggaccatgaggtcagaagttcgagactagcctgaccaacatggtgaaaccccgtctctactaaaaatacgaaaattgccgagcgtggtggcacgcgtctgtaatcccagctactcaggaggctgaagcggaagaatcacttgaacccaggaggcggaggttgcagtgagctgagatcgcgccattgcactccagcctgcgtgactgagtgagactccgtctcaaaaaaaaaaaaaaaaaaaaaaaaaaaaaaaagaagaaaagaaaagaaaatcacagcactttattttgatgttcatgtcattgactaaatatatatagggttgttaagtaatagtcctaaatactccaaagtatctaatgcacttaagaaatgcattgaggattttcaaaatatatttgctcttgagatcctcaatctactgtatgcattatacagacgtaccctggagttactgcaggtttagttctagctgccacgataaagcaagtcacatgaattttgtgttttccagtgcatacaatagttacgtttacactatactgtggtctattaagtgtgcaatagtatgtctaaaaagtacataccttaatgaaaaaatactttattgctaaaaatactaatgattttttcgttttttgagacggagtcttattctgtcacccaggctggagtgcgatggcacgatctcggctcactgcaacttccgcctcccgggttcaagcaattctcctgcctcagcctcccaagtagctgggattacaggcacctgccatcatgcctgactaatttttgtatttttgtagagatggggtttcaccatgttggacaggctggtctcgaacttctaacttcaagtgatccatctgcctcggcctcccgaagtgctgggattacagtcatgagccacccgcgcctggccctaatgatcatttaagctttctgcaagtcatagtcttgttgatgaagggtcttgcttcaatgttgatgactgctgaccgatcagggtggtggtttctgaaggttaggttgactgtggcagtttcttaaaataagataacaatgaagtttaccacattggttgtgtcttcccttcatgaaagatatctctgtaacatgcaatgttgtttgatagcatttcaaccacagaacgtcaaatttggagtcaatccactcaaaccttgcctctggctcatcaacttagtttatgtaatattctaaatcctttgttgttatcttgacaatgttcatagcatctttaccaggagtagattttatctcaagagaccactcttttgctcattcataaggcgcaactcttttgttaaggttttcttatgagatcagagcaatccagtcacatcttcaggcttcacttttaatgctagttctttttctatttccaccacatgtacagaatattaattcttcactgaagtcttgaacccctcaaagtcatctgtgagagttggaattaagttaatacttcttttaaactcctgttagtgttagtattttgacctcctaccatgaatcataaatgttcttaatggcatctaggatagtgaaatttttccagaaagttttcagtttactttgcccatatccatcagaggatgcacaatctgtggtagctacagccttatgaaatgcatttcttaaataagacgtgaaagtcaaaattactccttggtccatgggctgcaaaatgcatgttgtattagcagacataaagccaacatcaatctccttgtacatctccattagagcttttgggtgaccaggtgctttgtcaatgagcagtaaccttttaaaagaaatctttttttctgagcagtgggtctcaacagtaggcataaaatattgagtaaacaatcctgtaaacagatatgctatcatccaggctttccatttacatcatccaggtggttccatttgcagagcaaagacagagtagatttagcatcattcttacgggccctaggatttttggaatggtaaatgagcgctgacttcaatatcaagtcaccactgcactagcctctaacaggagagtcagcctgtcctttgaagctgtgaagctaggcattgactttcctctctagctatgaaagtcctagataggatcttcttccaataaaaaggttgttttatctacattaacaatctattgtgtagtgtagctgtcttcatcaaagattttagctagatcttctagagaacttgtggcatcttctccactagcacctgctgcttcacctttaacttttatgttatgaagatggcttctttccttaaacctcatgaaccaacctctgctagcttccagcctttcttctgcagcttctttacctctctcaggcttcatagaattgaaaagagctagggcctttctctggattaggctttggcttaagggaatgttgtggatagtttggtcttctatgcagaccactgaaactttttccatatcaacaataaggcttttcaagtttcttatcatttgtatgttttctggagtagtacttttaatttcctctgagaacttttcatttgcgttcacaatttggctgcttggtgaaagaggcctagctgttggcctatttcagtttttaacatgcctgcctcactaaacttagtcattcctagttttttatttaaagtgagagatatgtaactctttatttcactttaacatttaaaagtcatggtagagttataaattggcttaattaaaatattattatatctcagggaatagggaaacctaagaagagagagagagaaataggggaaaggccagtcagtggagcagtcagaacatgcgacatttagccattaagttcgttgtctgatgtgggtgcagtttgtggcatcccaaaacaattacaacagtaacgtcaaagatcactgatcataaattgccataacagatataaaaataatggaaaagcttgaattactttgagaattggcaaaatgtgacacagaaacagtaagtgagcacatgctgttggaaaaatggcaccgatggacttggtcaatgagttaccacaaatcttcaatttgtgaaaagtgcaggatgtatgaagtgcagtaaagcaaagtgcaataaaatgaggcatactcagatattgattttgcaatgctgtatagtattcataaatctccttagaatacaacgcttccttttacttcatcactgctgtcttaaaccaacatgttgggtaatagaacatttggaaaacattcaaaactattttgtatctgtttctgtattttaagattgtgtcaggtttctttagataccacgcatgtattttaaagatttaagggcagtttaggatgatatgttttcctttcaatgtacttctctgtaaaaaccagcattgaaattttgctttagtactgtatgaaaatgtgaggtcaagttttattttgtacttgtttaaacaattgtgtcataaatccatgatgtctgtctctctaaaagttttcgttctaaatgtttgtatctttttttaaaaaggaaaaaaacaggcctggcatggtggctcacgcctgtaatcccagcactttgggaggccgaggtgggcggatcacgaggtcaggagatcgagaccatcttggctaacatgatgaaaccctgtctctactaaaaatacaaaaacaaaattagccaggcatggtggtgggtgcctgtagtcccatctacttgggaggctgaggcaggagaatggcgtgaacctgggaggtggagcttgtagtgagctgagatcacaccactgcactccagcctgggtgacagagtgagactctgtctcaaaagaaaaaaaaaacggggaagaaaacaacctttttagtttttgttttgttttgttttttgttttttgtcttctagcccagcaacatcgagggaatcttaaacatgacaagaataacaaaatggtattgggagaaatctttttgcagtggggaaggaatcttcactttgactatgaaagggaggtctatctatctatgatataattttattatatgagcttaagggctttaaaatgatgttattattttatgtatgatctcttggagctggtttcatttcatcatagctctcgtaactttccaaattgctgcttaggccagcgtagaaggatgtaaccttgagcaagtcattttaccgatgaagccgcatctctcttctgtaaaatagggcactcagtaaacactaatgtatatagctattatttccttagaagtcattgaattattcggtaaaagtaaaagagcaaaataataatcatggactgctcaaccttagatttcccatccatttcttcaaaatatgctaacccaataatgtgatataaatctgtaagtagtcagcattgtaaaccgtcaatatttttatggaggttggaatagatattatgtgcacattgaaatacaattacagcaagtacttgattactctgggcttgaatagccagtgtctagattgcatcagcctttgtaaaacctgaatattcttcttctggccatttcactgttcattaaactatataccagaacatgagcagtgtgaagagattcagataaaatggaattcaaactatttttgcctgttaggaaaaaaaaatactgttaattttttagggaattttagctatgggataatagtaagagttttctttttttggtgggtgggggaggaaatctggcagtgatcagattgttttacacatttaaattaggttatttatgctctaccacttactgaaggtagttgtgagtttcctgtaatgtgctgaatcttaatttacactttaccatctgtctgtgcttaagattttaatagattttgccctatagtatcctcttgtagatgaaatccatctgtgggaaagcatccacttttgtaaatctacctagcctgcactattgggtctctaaaccagagatacaagtgttagtaaaattcaataatttttattttttaatgctaccttgttttattttattttcatagtgtagagctttgaataaacattaattagttgacctggtagcaacaatattgtggtaacgatgcagctgacagtattgtaacattattagtcaagtcataaggctagtgtcttattaacctgaaagtttgatttctacataaatcagtttggcttttctcttgcaagagtaaaagatgataacaaatcaaaataaaacctaccttattgtttgtttttagcacaaaattgctgcagtatttttttgttaacagttttaactacttatttttaaaaaagaagttcaggatctttttgtgacatcaaatctgtacagttatgctttataaattatggattgaatgtgagaaagttaatagtactgaattaaattcacatacaacaccagatggtatttaacaaatttaagaaatgcaactttttggccgggcatggtggctcacgcctgtaatcccagcactttgggaggccgaggcgggcggatcatgaggtcaggagattgagaccatcctggttaacacggtgaaaccccgtctctactaaaaaaatacaaaacaattagccaggcgtggtggcaggtacctgtagtcccagctacttgggaggctgaggcaggagaatggcgtgaacccgggaggcagaggttgcggtaagccgagatcgcgccactgcactccagcctgggcaacagcgtgagactccgtctcaaaaagaaaaataaaaagaaaaaagaaaaaaagaaatgcacgcaactttttgtaatttatggtcacatatattttaaatgtgtatggatgtttttatatatacacatatataagtatgtatatctctgtatacatgtagattcccactgtgtacagacatatatacaaatacctatatttatatgcaatgacacaaattgtatgtttgtgcatcttaatgctacatataacaaataaaatgattatgtagttatgtaatatgtaatgattatgtagttatgtattatcaatattgtcatagagataatgtctgtggagtcagtgtctggacagtgtctgtggagtcagttaaactaaatgttaattgggtctgccctttactgcttataggatttttcatctctttgagtcccagttgcctcacctataagctagtgcatatcaaaaaggatatctatggaaagtagatgagacaacaggagatgtttcaggcacagatcctgggacttttaaaggctcaaagttggtcactttcccttaggagtaaagcagtacaaaatttgtttgattctcaaaaggccacactatgttacaaatcagaaaaagaatctatatgcatggcttccaaaaccatgtggttattctccaaataatccagattttagaagaattaaataactgtaactatttctcttttattttccactggtattgtctttgagtaaaacaagaagatcaacaaaaatatgaaattacagattttaatagcctagccagtggctaggaaaatggtttaagcatggagcacactttatcatactttccaatgagccaataaatagaagaaatttttaaaaattaatttgatacatatttggaaagaaaatagaattctcactttacctgtccaactgggaaaaattgctccaattatatatataccctaaattttatttttattatagataccataaactggcattgatgcgtcccctaaaatactcttgttggctcttgcaggggatgtgtgaagagatatgctcctggaagcatgccccttgaggagagggtggcctctgtgctacagcctgaggggctttgacatgctacttctcagacacccttcacacagagccactaccccccacaaaaagaagacctacaaaacattcacctgaattcttttttttttaaatatgtttgctttgccaaataaaagtccccaggccacctccttccacttagtttttaagttcctcacaagttgcaattttgtagtcatcataatcttcagggtaaatgagtgccaaataatcagacatttacgttacagcaaaacgtaaaataccggcagattgtaaagtttgaaagatctaacaaagaaaaaagtgacattgctaataaaaatgctgtattgatgaatatcaatattgaaggttctggagtcacatcacaggttcagattcctgctctactacttatttgtggtgtatctttgaacatgttacttaacctctctgtgccttagttccctgtctcaaatggggaaaataaaaccactgacctcatagtggttgtaatgtagtgaggattaaatgagaaatacatgtaaaacacttagcacagctaagttaaaataagggttaatttttgccttaattccactattattatgatgtttattaaatgtgtttccattgcatagaactcatgaatgtgcttgaaggctggaattctttcacatttttgatgctacaatacagtcagtctttttacaaaaatgatagtgattgtgcaacagtctttaaatggaagaaagaaaataaataaaacacaaggcatctccttttcccattttttaactcaaacagtgaagctttatatggtgcttttctcgataaagcaccagaaataaattgaatgctgtttattagctggacacaaagtgtcctgattgcttcagttcatctaggcatgtaaattattcagcattccacactaaattggacttcaggatccaagcatcagtaggaagatatttcctgagtagcttaaccaaatgtacatgattgtaataagaacttctaaggcagtcctacaaggaaacaaatcactctgatttggtaaggaaaatggggagttccacaaacttcatatttttatctaggcacaattagcttacattcagagggacaattaagatgacagcctgcctagaagggctttgcatttgtttatttgtcctgttcctgatacccaccagatattctatcttctttctaaatattattttctttgctaaacaaatagcagagcttatgctcttagctggatccacacataaccttgtgaatcattttcagatgtcatagaaatgacataaacacagaatgtcagaaaaatattagccagaaatgcaatcaattgttcaatgataccataagagactaagtgcctggtacagtttggctgtgtccctacccaaaatctcatcttgaattgtaatagccataatccccacaacccccatgtgttatgggagagaccaggtggaggtaattgaatcacggggtggtttctcccgtgctcttcttgtaatactgaatgagttttcatgagatctgatggctttataagtgtttggtagttcctcctgtgttcattctccctcctgctgtcttgttgaagaggtgctttgcttcccctttgccttccaccatgcttgcaagtttcctgaggcctccccagccatgcagaactgtgagtcaattaaacctctttcctttctaaattacccagtctcagacagttctttatagcagtgtaagaatgaactagtaaagtgccctaacacattttggtctttctgtgtttctagaatgttgacttttttcaatcataaggctctttgccctatagtcacaagatagctgctacatgttcagccgtcacatctatattccaggcaagaaaaaataattggtaaaggctttctcctgaggatttttgttttgatttaggaagaaaggctctctccaggagatttttccctaatattttcttaactagagctggctatcactaaacctatcactgggcaagggaaatggctgtgaagtagacagtggacagtgtctaccatgcctctctttcacagatgagaaaaccaaggtctcttcaccagaacagacttgtgcaaggcttcagagtaaactgaagagaaaaagatgatcatttctggctctggtggctcccactctaccaaactgtactccctccattaatcaattaagtgtttattgaaatcctctctagaactgtgttattattcccaaaagtcagtcttagttacctataaggaataattagaaatccaaagtatattaattaataaatcagcataccagatatctggaaaaatactttgtaaaagatatttgtttattctttcaacctttacagaacctgatatagatttaaatgtcagaaaacttcttgaagcatattgttttcttctctgcagctactgtgtagtctgttgcctgctattttcatggcaacaatcacaagttggacactctttttagctataacaggactagactgaataggccagctgagagctattttacaagaaaatttagcaatcactttgcggtaatggatattggtttgtggcacatccgttctggtttctgccttgttaaacactttaaaaccagctctagcatacttagcttctctttctcaccctctgggaactataagtttactcgtctttacagttggtggtgaacaatttttgattttatgctgcttcaaatgatggaaaaggtactgatttattttaaggcaaagtgacaatatagtttgtagattatttcagaatttttaaaggcatttttaatagtttagagaaaggaagcaaacattttgttaattccttattgtcaatcccgggggaagctatagtggtgaattagtcaaccttgcattttacattagaaacatttttaatgtgattgctcttggtataagacacttaataaaatgtcatatttaaaaacaacatcctggcctctcctctgggaccatcaaaccacactcaaaacattgaagcggttcacaacatatatcttatggaaaaatgaatatgcagtgaatctatatacttatgattatagaaataaagtatatgtagctttataaagtagtataatgtttactctaaattttagtagtaaagagtcatgagttttgtatttaaaatatattattaggtctagtttgaaagctaattaaaagactcaaagaaataggactttattgcatattctttcacaaaattgaactctaattcctacacttgatatttactctaaacctgaaataatttttctgaaatattgataatgaatatgaaacaacctcctggatagtatttcttaatttctaagccagggtaagccagatatagctgaatgtgtaaaaaatgttgcaagagatcatttttagatgattaataaataatcaagattagttcttgtagttaacaaagggctgaaacagttgcaatattcagaagtcccaataatataatggttttgtcatggattaaatatttctggaaacacttcctacttgtcacagttctcataatgtactttcacttgatttaatataattaagtaattaaaacttctcaaagtttggtcagatctcagtttctccaaaatagaaatactaaatcgtgtgtataacttgcatcgggaattttaatataggtaggttctcccagtcacattgaggaggtcaccctgacaccttctcatatcatcccaatttcatttttgttcaaagcaagatctaataagaggaagaaaaatgatgccaatgctgtcagatctcaaacaccatctgtaaagtattccatattaccatgccattaattgtgttggcataggaagaaaatattggattgggtacaaagttatagggctaggtagaaaacatacaacttatccttttttattaatgctatatttaagcctacaaaactgaagggtttagttattgttagacagaaatagattgcatatggtatctgttagaaagcatcatcccagtaagaaaaagtgtggtcttgatggtgcacttcttcctcactttttattttcatcagttactttttactaccttcatctatcaatttccatttaattccttttaagggtagcatacataaaacattatttcatagtgcattattcaccctagaaagctcattgcattcacttgataagatacatttcataatttttaaaaagtgatttcattttgtatgtacttgtccttgcatagagcccaaagagctcagttctgttttagaggacattgtgataacttcctttataggcagaattaacgtaggcaagctgcataatgctatttattttcaggatttggtttttcagtttaagtaagaattttcattttaaagattagcaatctggtagaaaaaatttctatgatttgagcaagtttgcatgtaccgaaatgttctctctgtggaagtcataaatggtttcctttctggggaaaccagagtatagtatggccaattaagaaagaaaagggactaactattgagactgtgtgtgatatgctgttactttgtacacatcaaattgtttattccacataatgatcttgtgaagtagggacttactaaagtccaggttatttaccttcccttcaactttacagctagcaaataacagaactccattttaaactgaagactcatcccaaagccatgccccactcaatataccatacttaccatactgctagtaagattaaatggctcaaagtgcataaatatactttttgatgtaagaaattatttctgttttggaatcatggggcatgaagtttctaccaaagcaaaaaggttgcataagtgtttattgacagcaaatattctaatttctttctctactgtaaaatgtggataagaacatctataaacaaaaatgtctataataaaataagaattaattatagaaagacttagccttttaaactttttttttgttgttatttactgtaaagttgtcaatccctaacctgttatgaacaaaaatgtctcacagggcatttggaacttttacatgtaacgacttcctgcattcatccatctgcttctatttttaaacattggggtttacagacatttagcacagtgccaggaatataatatatttaaataatattgaatttatgcttttaataacatcagggcttagaatgaaataagcaattcaatctgtcaccctttttgcatttgtgtgttactaccatcatctcccatatagtctcttcttttaaaagtcctattatgtgtgtgcctaagacttattttgagaaatacttactggccgggtggagtggctcatgcctgtaatcccagcactttgggaggccgaggcgggtggatcacgaggtcaggagtttgagaccagtctggccaacatagtgaaaccccatctctactaaaaatacaaaaattagccgggcgttgtggcacgcacctgtagtcccagctacttgggaggctgaggcaggagtatcgcttgatcccgggaggcaggggttgtgctgagccaagatcgcgccactgcactccagcttgggcaacagagcatgactctgtctcaaaaagaaaagaaaaaagaaaaatacttagtttgaaaatcaattaaaattgaaattaatttagctgggaaaaatattaagactataacaaacactgtttgacagcactgcactgtcacaaaacagagttaaaacattaaaaagaatgttttgttgttgtttttttttttgagacggagtctcactctgtcgcccaggctggagtgcagtggcacgatctcggctcactgcaagctctgcctcccgggttcatgccattctcctgcctcagcctccggagtagctcggactacaggcacccaccaccacgcccggctaattttttgtatatttagtagagatggggtttcaccctgttggccaggatggtctcgatctcttgacctcgtggtccaccagcctcggcctcccaaagtgctgggattacaggtgtgagccaccgcgcccagcctaaaaaggatgtatttttaagaggcagtatggtacagcgagaagagccctgtaccgtacatcattaaaagagatcctggtgttgcctggttcataaaccagatgcttgtgtttatgaatgtatgtatggaaatttaaaaattcctgggctcatcacctttacaagaacatataagataacatacaggaaagtgcttggtaaacaatacattgatttcctgatgtaaatgactgctctgattattgttgctgttattaatagcaccaattaatagtagtgctagacttaataaatgatagtagttattggcataacttctcagttgaagtccaaaaagtgatttcaagtaatttaaactatttttatgcctctatttatcttatttttgggctatcccttctacacttatttaatttgtcctcatccctaagtggcgtatttgagaatgttatcattgcctaaataaatgtattacattgaaaagaagaagcatctcttaatttcttgatagttagtggtatgctggtaaagtggctgtcaaggagagtggggaaagatgtaaaatgccctaatttgtagagttagcggatttctgtatgtaaatactactcctgtggccagtttcaagctgtcctcgtgatgtcactgaccacagagttgagaaaagaagctcacaactgactcgagagtgggtgggagctgggtccagcatatacaccgtggacaagggatccaatgggtgtgttcaagatacctgtttcacagtgtaaactactgagaatgaaggcatgacagaaatatacagttctatctcaggagatgaccttttagctctttgactctcatcttaatacttgcttctgctttttaataaagcattgaaattcagtcttttgggtattcaaatctaaactctccccaccagatcctggcttggctcagcctgtaacccttggcagctaggtggtctccagaagaaatcccctgtttattctgcctgctccaaatttagcccactactctggccacagcgtcctatattctaggactggtcttctccactctcttctacccgagggtgtaggattcagacagatgtaagcatggtaccattgtgagttaagatggatgctgccacagtaggctgctgtgaagaatgcagactggagaatgaaagtctaataggttggtttggggtcgggtgcagtggcttatgcctgtaatcctagtactttgggaggcagaggctgatggattgtttgagcataggagtttaagaccagcctggacaacgtggtgaagcgttgtctctacaaaaatacaaagctactcaggtggctgaggtgggaggactgatagagcctgggatgttgaggctgcagtgagctgtgcctgaattattccactgcacaccagcctaggcaacagagactgtctcaaaaaaaaattaaaattaaaaaataaaataaaagctcgttttgggactaaaattttagattcatttcggtagcaggtaaactgttaccacagaatttaaatacacagtaactatctgataaatattatatatatataatttatatatgcattaaatataatatatacacattttatgtatctatcatatataaatatatatattatttttatatatatatataatttactttctgccttgtttcagaagggatttaaagtgtcagaattttaggggaggcatcgaatgggcaaatataatcataaatcctggttcttggggcttccaacttcatgtctggaaaataacagatgattcatacagaagatagcaaaagggtgcccagtgcccgtcataatcctatccttcattttataatcctaggtctgatttttggtttatttgtttgttttgtatgtttgcttctatttactgcctagaattcaactatggaggtttatttggtagaatttatctgctaaacaaggatttattacacttaaaaaatgcacatattctgagaaagctaagatgccagcgaatattcactcagttcagttatttttaaaaaattttccacattcccggtggaatctgctataggggaagctgttttaatggaggccgagagttggacaattttgtgttatggagaattctgggaagaaggaaagacccggatgggactgtttattaaggcttatgactggactggagataaggtaaattagcattgagaacatacagaaccacaggcaaagttctagttttttagtaataaaggggcttatctatacattttcaatatgaaggagtcaaaattgaaattcagctttatttctttacttcacaactcaagtttatttcttttatttatccattcagcatttgttaaattgttggattgtgccaggcatagaggtaccaaaaagcatttttagctcagatttgtagtatcattcaaacatatcaaaagtctagccaggaaaaccaagcgatatttaatatttgtctttataaactggagaatgccaatattctactcccatccttcaaggatgaattacaaaatctagtcacattctcagcatctgcagtttgtaacaggcctggcatccagaaagacagcctagtggttgtgttctaactatccttttaatggtattagttctggaaaagctggattttctgcttgaaaagaaattgaaaagagaaaatcattttcaggcattctttcttttttttttttcttttcttttttttttttttttagaggcagcctcttgctctgttgcccaggctggagtgcagtgcaccatcatagtttactgcagcctccaactcccgggctcaagtgatcctcctacctcagcctcccaagtagctgggactataggcacataccaccatgcccagctaattttttaaatatttcttgtagagacagggtcttgccacgttgtccaagctggtattgaactcctgaactcaagcgatcgtcctgccttggcctcccaaagtgcagggattgtaggcgcgagccactgcatcccgccccaggccttctttcttttgaagatttgtggttctaccatttatttgctccgttgccttagacaagttatttcattttctgtacctcagtttcattatctctgaagtggagacaatactaggatctgcatcctaaatctgtaagtattacgtgaaccttgtaaagttcttagcagtgtctggcacatagtaagtgctacaactctgccctctactgcttagagagaaatgtgaggcctaaacatgggtgccagatttcaacctgaaacacctccacccttgcatacacgcacacatactggcaacataatctggcctattaaaaaaaaaaaaaaaaaaaggattacacagtgaaagaaacaaccaaaatggaaggaaatatcttaactagaggtaatctgacataaaaccattgtagctgacaatggcatattaaacccaaaaatgttctaacctacgttgtaaaaaaatttaaactacatatataaaattatgtctttactgctgagattcttttttaattattaagcaatgcaaaacaaaacaaaataagaatattcaagtataatgcttatcattctcctaatggaaatacagagttaagtgctatatattaaatatgtattattataattatacattatttgggtgaattaagttgacatctaccagataaggaaatatattttgaatatctatgttaacagaagatactgtcctttcttttgaactgtttaaaataatttaacatagttaagtaatactcagtaggctctggaaaatctgtgatctcacattcactgttaattcaaaatacactgaataaaatactattcaggttcatctgaatcttggacttacggtttctaattctgagaccagacaacagacttgtggcaccatcttgttctctcacataatgggagcattttggctgtactgagaagactaaactttagtccagtatgtgagtctcatgacaaattgttgtttccgttacctgtctggtaagaagagaagactcctgtccaattcttcaagaatggtatggaggtagacagcaggaaaaaaatgtggttttttttccctgtttaagctgctacattccaacttggttatggagtgtaagcatgcacattcacaccagagtgaatcgtgtggaggctcttgtccagtagagccactatccaactccagcatcaggcatcactggaagactcatcaaggcattcttccaagtgggtttacaagtaccagaatagtctgtaaaatgagtccttggcatcctgaaatggccctggatcccaggggctctgaagagtgagaatgagccaggttgtctttagcttagattaggtcctgttttactaggcagctaaaggtaacaggttgaagtgatgcagggaggaaagatgagagagcctttaatggctcaagtccatgagcagtgtgggagtggaaaaagcacaggatgtgcactgagggagttagaattcggcttatcctcctctgtactctcatggtgccttatgaaaaactcatcgcagagctgagcacattgaactctaaacagttttatgtgcctttctccaccactgtatcatgagctatttggaacacacacaatattttcttctccaaacttttaattttgaataattttaaagctacagaacaattgaaagaatagtacaatgaatatctgtgtgtacttcactagattcactaattgttaacatgatgacaatgttatctttctcatctcttcaggaagatatatatgtatataccatgtgcatacacacattcatatatctacataaacacacacacatattcttattttatttctttctttatttttttgaggtaggtcttgctctgtcacccaggctggagtgcagtggcgtgatcttggctcactgcaacatctgcctcctgggttcaagcaattctcctgcctcagcctcccaagtagttgggattacaggcacgcaccaccaagcccagctaatttttgtagttttagtagagacagggtttcgccatgtcggccaggctggtcttgaactcttgacctcaggtgatctgcctgcctcagcctcccagcgtgctgggattacaggtgtgagccaccacgcccggccacacattcatttttcttctgaactgtttgcaagacacttcacctctaaacacttcgtcttgtatctttaaagacccagacattctcattactacaatactgttatcagagccaagaaatttaacactcattcaataatattatctagtatgtaacctgtattcaaattccttcatttgtccccaaaatgttctttttctaataataataataataatccaagaataagcaaggttaccatgtttctttagtctcctttaatctagtaaccagcacctgcttttttaaaattttgtgacgttaatgtttctggaaataccaggccagttgtcttgaagactgtctcccatcgtggaagttcttatttgcttactgatcattaggttcagagtatatattttttggggaaataaccaaatagatgatattggacactttttatcaatttacttgtaaaagtacctctctgcctctgtaatgaagaaggaatctgtaggggatacttcaaggccatgggaatatcctgtttccccacattctttcacccagcagtttcagcatacatcagtgattcttacctgagtctgttactatattggaggatgaaatggtgattttttgtttttaaagtttatcattctttctgcccttactaactggcattcttctctaaagaagacttttcccccaactcctctccttttctaaagcttctccttctctctccccgccgacgcctccttccctccctccctctgttagagtatctctatagcctcatggattttccttcagtaaatgtcttataatctaataccatcattattatatttggtgcccaaattatttcaaatttggccattccactgggcgtggtggctcacacctgtaatcccagcactttgggaggccgaggcaggcagatcactttaggtcaggagttcaagaccagcctggccaacatggtgaaactccatctctgccaaaaatacaaaaaaaaaaaaaaaaaaaaaaaaagccgggtgtggtgaagcatgcctgtaatcccagctactcaggaggctgaggcagaagaatcgcttaaacgcgggaggcagaggttgtagtgagccaagatcatgccactgcactccagcctggatgatagagaaagactctgtctcaaaaaaataaagagaaaaaccaaatttggccactgggagccccaccaagacagtagtggtgtcctttcatcaagtctcattagtcagtccttcaacacttctctgctttctggtgcaacaagatgtccagagactctttgtattttccctgtgccagtcctggagtcagccacatttttttttcaaggacttcttgttccttttagtggtaaatggcatttataaaccaagactggggtgtcattgcttctaggacaaaatgaagtaattgctttgagagtacttggtgaaatataaaatgctatattatcatgactatgattagtgctatgaaacaagtattcagcttacttggaacaatgccaaataggagcaccaatataaatctgtgtgcagggaataagtaggaggtaggatatatgtgagggtgaaggaaataaataagctagcttggttagatacaacatgagtccttgtcttctgactctgagactaaacagaacagatgaaaggctatggattgcattctcacctgttccctgtgctgctttgttatttaatacttcagataggaaagcatattttattttgtgatacattgaaatcttttcaaaaaaatgaaacatttatgtgaagaatgataaaacatacatttgtgatttcttgtgtttttacttttcttacatttatttagtaggtctgaaagaacagtgtaatttagggaatataagattttttaaaattgcaaacatataacttcttttattttcccagtggatgcagtacctatgtcacatttaaggaactggtgtggtgacaactttgagattcttttttttttttttttgagatagggtgtcattctgttgcccagggtggagtgcagtggtgtgctcatggccctctgcaggcttgacctcctgagctcaagcaatcccccacccctcaggctctcaaagtgcggggattacaaacatgaggcactgcaccttgccaatgtttatattttttgaagagacagggtcttgctgtgttgttcaggctatctttagatttcttgtgggcaaatggattgttgtgggttttactttctatgattctatttcaagtaagaagcacacctatttgactatgatttcatttttaatacatactataaatatgatatggtttaatttcaagactttcttgcttttgccgtatcactttatactctcaaattaaaactcttaaaaataacttacccctacatgaccacagattatgataaattggacagaggacggagatgagtaaatagatgatgcttagcatctcattaatagcaaggaaggaaagcaaaacagcccagatgaccagaaaacaataattcttttctttatatcttcatctggactgttacttctgactatggtggcaaaagcaggcatgaggttggaggaaggagaacacacacagagactcaatgattttacacgtcctcttttcattagaagctaggctaaaaatagggaagaacaaagacatgtattgtatgatttatgtcggaatgtcttttattcttatatttttggttttgtgtcaaattcaggtgaaagaatgtcaaatgcctgtgtgtgtgttggcatctgaacttggcaaagaaggtgattgggtttggtagggctttattccagctttttcaagaattcctcacttttcaatactgaacagaacaggccattctgataaagaatccattacatacgtagaaaaattcaggctcatgaagaagctggggccagatttgtctgattcatgaaggttcttcagtttctagcagtttgtccttggagaagttatttaacctctctgagtctcgacctgctcacctataaaatggaggtaataagaggacattcctcataaggtctgattattatgtgtaaagtgcttaatatagtgtaggcaaattataagcacacatcaaatattagctcttatttttattacttatagacacataaatggacatgttaagaaaatatgattacttcttatcaatgtttgaaaattttaaaacaatccaatcaacaaatgaattactcagtcttcaaactatgttgtctaattttattttgttattggtttctttaactttcttcttttgaggtgcaatatttttaaagcttttacagctctctgtattatccagaccaccaacttaatgtaaggcacattgatgaagcactcagcatggccagggactcttgtagttgtgaaggatccaaaaatataatgatatagttctccgcaagtagctaactctggtagtactgaccattatataaacaaggaaatgtcattttgtttgataattactattacaagatatagtgaagttataaatttgggaaaattaaggaattccttatacttaagggtcatgaaagatatattgatgttccccaaattaacagtgctgaaactcattcttcaaaatgaaaataaatataaaataattttgctcagtgactagaatatttttaagaaagtgtgctttaactctaaagcaaacatgaacacatatgtgattctggatattatactttgggatttatcataatgcccaaggcactacaatattactaatttatttatttcctctgggcatcttgtaatttaagagggtaagatatcattttcccctttcactggagcatatgagtcacaaaggtagctacacactgggggtgtctccagcttgaaaaaaaaagctaatgcaggttaggcacgctggcttacgtctgtaattccagatatttgggaggccgaggagagtggatcacttaaagtcaggagtttgaaaccagcctgtccaacatggtgaaaccccctctctactaaaaatacaaaaattagccaggtgtggtgatgtgcacctgtagtcccagctactcgggaggctgaggcaggagagtcacttgaacccagaaggcggaggttgcagtgagccaagattgcgccaccacaccccagcctggatgacagggtgagactctgtcaaaaaaaaaacaaaaagcgaatgcaaacagcatcccagtgaagcaccagaaaaactgaaaccaatgcctcaaaagcccagcggtgattgcacaccagctcaaataccaaaacagaaatttttctctttcttgactcctcaactagccttagaatataaagcagtttttaaaaattgggggtcatgtttcatttttgaaaaattgaatcattaatgttagttatccacacatctcaggatattaaaagactaagaaatacattaccagaactgtttttggatattccattgcttcctgggtacctgattattcacattatgcacattacttatgtgaatgtgctgttgaaattttcagctagaggactgagatgccagaccttaactcctgccaggtctttagccttgtctctgctgtagaatcagttttgattatatacagaatataagagagtacagagtagtagaatggagttttaaaagcatacctgtagtataaaagcatatgacctgaattcatatccagtggtttagtcttcctgtgtcctagtctgatcatctgtaacatgagtataatgaaagtaaccacctcacagagttgctatgaggattaaacaagttaatggctggtgcaaaagtgattgtggtttttgtcattaaaagtaacggcaaaaaatgcaattacttttgcaccaacctatacaaattgatgctcaaaaaatgccctgtccttagtaagcaccttataaaagattttcattgttatctatagagatccacgagaacaaccctccttcagaggccatatgaatctagttcaagattaaggacacctgcatcgccaccagcttcccaacccacccccgtatacttctctagctcatagtgaaatcccttggcctctctcagactaaagcaacagtgtggctggaatttccaagctctggaatccagtcccaagctctgaagaccaagatgatattaacatagccccttgtgggcgctggctgtgctgttcccaaattcctcatagaggttttggtctcaaccaagatagaacactgtggaagctgaagtaatgtactttcatctgaaacagacaggtgtcttattcactttatactttgctttgcgttgaaaaaataagctttttttttctatggttaccagttcacaaacatcaagtgcaaaacttgcacgtactaggtgataaaaatatggcaagaatgctgaaggtaactttctaactttaagcaatgtttgtagatcttatttaaagcatatgttataaataccatcttggaatcctctttgtactttcattcatctctcaacagtcaatgtgaaatgaaggtcagttagtcttaaaatatccttgatcagagcatttttttctggatttttacctgttattaccgatcgcagctaatgaaaaagggataatacgaaaaggaaaatgaatagaaaaatgaagggaaattcagttgcttcaaacaatacattttaatttgtaatatctgtaagtgtagaagacattgatataattcagtatgctttgttctcagtgcaaattcatattcacatatagattgacccctgtacctcatttttggaactccctgttggttttgtatgtacaagaggcaaatacctttacatctggtgaggaaataatttatctcaagttattttgaatcatttatgctagtgttttttcaaactggatttaatgaaccagtagcgccagcatcacctgggatgctaatgaatgcatgttggactgatggcttacctctagacttctgagtagaattacacaaaggtgaggcccagaatctgtgttttagcacagctctgtggagtaaaaaaaaaaaaaaaaaaaaaaaaaaaccaaaagccaggggtagccacaaccttcatgtctactttcatagccccttccccatagatggtgctggggggcagtgcaggttcttatttcataacctgttatggtggtggttgttttgaaccacagatgcaaagaattaaccttctcataatcctcacttctttggctcattatcatcagatcatgcaaatcttttttcatgctttacgttattttaactttttttcctttcatttctgagctccacttccattctcctgcccccacatgccctcattgcaatgtgttgtagagatgcccatactgttctgtttctgccttttttcactcaacagtttagagtttctaacagctgcacaggacagcaagattccttctgccacctgtgatgtgtctccgccccttgctgtgaacacctcagttgtcttgactcccaccatcataaataccgagctcaagcactaaactcagattcaccgcttggctgcttcactttcattaggcttcaagattactcataacatttaatttgctattaaatctagactttaacaactctttttcattgattgtgttttaagctgcctggataacatgtattaggaggaattgcaaactcaatggaaaatttctttttgtttttatttttttgagacaggaacttgctctatctcccaggctggagtgcagtgacatgattatggcttactgtagcctcaaccttttgggtttaagcaatcctttcacctcagcctctctagtagctgggactacaggtacacactaccatgccagctaattttttttttaatttttgtagaaacagggtctctctatgttgtccaggctggttttgaactcctgggctcaagcgatcctcccacttcggtctcccaaagtgctgggataataggcattagccactattcccagaccgaaaatatctatacattacagattgaattatatctgtatttccttaactatttccatccatgatttatagcttctttaaaatgtcagtcataggtatatccttatccaaagtttttttctttttctcacatttgtcatacaattttgtgatctttctctctgaggccgttagctctttgttaactaacctaagttcctaagaaagtccaacaagaaatcacaaattcatcctctctagtacaaaacatctgtcctgtgtgggcatcatttcccagtgaaatattaactcttaatacaaaggtcacaatgtaggattgttttctcttgttatttgctcatcgggtctcttaatcaaaaatgctacctttggatttcttgtccgactgcacagatgtttaagaaggaaatttttctaagcaaagatttttttaatataagtagccaagcattcaatctagggaagaatgcaaccagccagtcaataatgatgaaatacttttttgtctgtttttcattctccctcactcagcgactgctgactatgcacctccaggccagaggcctattgagagtgacattcactctttccaagataatcctcatgataggatgcacttaatttatcctgttgatgagactgaactgcattgatttgcatatcatcaatacacgtaagtcctgagtggaggaccaaccatcctaattaatatatcctctgtcacggacttgctgtatctagcaaattctggaataatgctgattgcaggtggctggtgaatattgacgctgttcaggatttataaggctgtattggaaggcacgtgaaactaaaatcttccttggaacaatgtccctgtttaaaactactctcattcagacccagctgggcattcagcaatgccagctattgagtaagatctttcaagtgcctcagcctgcttcacctgtcagactggctcagtggtttaaaaatgaaactctatttgtttccaaagctcttcatcctccaactcttctctatccatgtcgcatattcttgcttcttcttctgatttgagtgtcttaactctcctaacacacatcatcagttttcatttaattcttttttcaagtgatgtacaaatagtgctgaatcagtcttggcgtttctgtgctattttatcatcttcacaacccccgtttgtttctttgtttttttgttgttgttgttgttcttcttcagcttttttctgttgtaagataagtttctttttcatcacacttggcttttaactcatgagtgtcagtttctcaaggtttccttttgtgcatttcttaacacaggcctcacatccctttctctcatccgccatcaatcaatcatacattttgttaaacagctccaaaataaaataagaaattataagaaaattagaagcatccccgtgccactagaaaaatctgtttttgaggcatcacctgcttttttctaatatgtcatctatatgcgtataagcattacagtagaaagtatgtataaactggacatttgattcacttttctttattttttttagcttcactggtttaaaaataaataaataccatgctgcagcactacatacaatgatctcagtgacaacatatcttcctccccatcagcgacttcttccatttttttaggtcaatgtccacaacacaaattaacattattcattgtacccagtgtaaaaggagcctaccagatattagagaaagttttgtaaaacacatcaagtttgcccctaactaacataaaaccaaggacctatatagatgaaagtttatttaaatgattccgtaactattttccttgactatgttccccattactttggggtaaaatggaggagaaagagttgaaaaggggaaggcaaaacaaagataatggaaaagtcaaaaaaagcaaaacacaagagtgtggtagctcaagaaaaaggtcagtggtcctgggggtgtggaaatttctcttccagacagatctgttggcccagattcttacaatagctatttttgcattccatttgaaataaaaaagtagatagaccatgcctagaaaaaaaattgagttccgttttacagaatattaaataaaacactgacttcttcaattatatgtttgctattagtagcaaaaggaaaaaaaaagccacaaaactatggaaaatgaaacgagtataaatataacataacatgaactctttctcgccaacttaatgataatgttgagaaggaatatacatatataggcattgcttatgtataatatttccttttgatttaaaagccagtatatcttttacctaaaatcctttgcagctgagaaatctgatgatagaatgagccatgaagttttagtagaaatagaaacagtacgcccactcttcatctaagttcctgtttcttttcacactagggatttgatattcatcatctttattctttggttccaatcaataggagaatttggaactttcatgcacatgtagatgtacttgaatacattctaaatattcaaagtgtgttgtagttctgttttattgaaatatctataaataaatacctgcatagataattaattctctcttctcatctctattgtaaccttggtacaaggactagaggaagaggagagactaagaaattacatatgtaattcctggtgaccatcaccctagggtacactgtcccctcaacagccaagagaataagtctggatttcataaatttttggaatatggatttcagttattcacaaaataaatatatgcattttcagaaatcattccacttatgatattgtatttattaaaccatcaaagtagacatattatttgaactgggaatattagatactgaaaataaaagctataggatcatgcagaatttaagcttcttcagaataatctggtcatgttaaggttaaagattactaaatttaaatggattggcactagctgacctcttaagttctgctggctctccaattcagtgaagttgctgaagactgaaggaacaagagaggtttaaaatattgagatatattaatcttcagtgcttagaaagcagtcaacaaaatagctccttttagtagttttcaaaaacaaatcaggtatttagatctactgtcatgaaatgtagcatttgattttgtagcatttgatttgatttcagtctttcatgaaattgtaatggccccacttgtggagaatttgattaaatgaaggttcatttcctgctttcaagaagatcagccaagaaattaatgactctagaagatggttctgcttgactggttggctgctaaataaaaattttatttagtaaaaaatcttccgcactaattctcttaattttccttcatggtttgcccatttctcttgcaaatattgtttgcctatagggtagttgtacctacagtgaatacggtttgtcttaacacttaggttatatgtaagataaaaataaatttactagttataactaaggattcacaagtagataagaaaaactgctagaataatttttgtagaaataaaaaaataagtaaatactttttaaaacttgaagtaaaggaagaggggttactcaaactccctataaatgtgccaaagatgaaaaatctaaaatttgtatattcaaatagctaaccaagacccaaaataaatgaaacacttacactacatgttttatctcatgatttctgaaacttttagccctaagacttttaggaaggtaatttatgcttcttatatgagctttaatgttttaatttcagtgtttcagtgttcatgcatgcatgaatgaatatttattgaatatttattgtgcaccagttatataccagacctagttctaggtatttgggatacattcatgaacaaaacaggcagagtcttgccttcatgaagcttacaagtgaatggggaaagacaataaaggataaacataacaagtaaattaattatgtggcacattagaagatgatagcaaaatggagtaagggggattgggagtaggaattacagattgcagtattgaataggatggtcaggtgaagcctgcttgagaaggcaatatctgagggaaaacttcatggaaagaatagaattgtctgaaatgaaaaagtgtccacaccaaaatttaactattaaaaatgtgttaacttttttaatggacatagattacataacatgatatggtgttttctcatgtaacgtttaagattcaccatgatgtttgatgatttctaacttgatagaataaaataagggtagtgattgtgttaagatacgtactttactattatcatctgtacttctaagataggagttaatttcaacaagatgtttcaaaacaatcataataagcccaaattgtcaaacagcaaagttctttaaaaacccatgagcctatattgcactcatatattctatatcctctgccaagattaaaccagatagatagtaattaaaattaagatgttttcctcacctccaggaatgcttgtttatacatatatattatttaaatatgaactgatggaatctgaaataattctgacagtaaaaatctatatttttaatcttatctgttttatgcacagcctacttacataacaagtagtctgtctaaactccctctcctggaaaaatagaaaattcttaattctgtgtttaatttatctcttccctttctgctatcttgtaagtgtaaatggaaaattcttagttctatgtttatctcttcctcttctgataccttctaagtgttaggctgaattacaaactaattagctgagaagtccagggattgaatttctgctctaccacttaccagctgtgttcccctgggcactttactaaacctaattaggcctatttcctcaactgtaaaatggaggcacatgactctcagaattgttgaataaaataatgtactcaaaaagactggcactttataggttcttaatcattttatcagaatcatgtcatatgcttttcaaattcgcaaatattagaataaataactgaatgtaaattactgaaaaatggaccaagcccgtatctaataacaggcattatagtataatgatggtttttgttttttgatttatatgttggcgattctgagaaaggaaagagctttatgacattatgtgcttgtgggaattttggaagccattatgaaaaaggcacaattttaaatgaacctaaaaggaaatgtaagatttgggttggaagagaagaaatcagtgattcctgaaataaacttacgattacgataggcctcaatgggtaatggatttttgtgaaaaggatgatacgggaagcatcttagctgtccattcttttgtcataatagcgtagttctgtaagggctgcttcacacaaatactttcacttgttgccatattcctaaaatacaaattttacttccatttctcatttcatgtgcttttactttacagttgccatttatttactaaaagccaatgtaaaacatactctccctactaaggagaatgtgcccttacaatttgtttatttaatatacacataatcatatagtctttatttacacagccatggttacatggtatgtgtgtaaaatatatgcttatacaagaacccttttgcataatattcactatagatcctaaaacttatgaatgaagaacttctaaaacaatggcaccataatatttattacaatttttattatgaaggtacattacattaatagagtgccctctaccccatgtcactgccactcaggtcaagaagacattgtacatcttccaagtcaatacagtctctcatactactttctacagaggtaaacagtattccgatttctttctctgaatattagttttatctgctctggaagttcatatattattccatatatttagtttagtatttactttcactagatattgccaaacagttttccaaagtggttgtattaatttaagctctcaccagcaatgtatgagagtcttagttgttcaactattatagttttcctttcaacctcttgagagcttttaattcccaacatagttcttaaagtgtaatgagattatgacttcaggaattgaagtagcaattatttttcataattatagttcatgtgacattgtttttaaaaagaagtttggtttattttactttagtaaaagtatgtgagaagactagaactttgagtatagttatttcatgagcttaggtggtaatgtcatatgaaatctaaatatggcttttaagcaagtgtttttattaaattgcagtcagactttgaatgctgacaataagaataacctgtctttctttctctctctccatttataccatcccattggctttaccttgataagtgaaataaaagcactgatggaataaagaaaaacgagaatttattacttttagaattgtgcaaaatttgtcagtgaaatatgaatatctcggaggttcaagatggtgcataatccaaaaataatttgaaatgtattatgtacatacatttggataagaatataagtgattttttaaaaaaatcatcatactaagattctaaatgaaatagtcaagctaaactctgttcatcataactcagaagtattaaagcctgattcaagagcaattggaaagtgatttctagttatcttgtcttactcttcaccctacttggttggaataaattcatccttctcattgcagtacaactctaattaatatcacagtgactatgtcaaagatgaccacatgcaacgcgtatctcaatatgctctttgctttttataaatatactttattttgtaatttgtttttcatccaagttcagtggagatactaaatattttgtttaaatatttcttactgggttttatgtataaggcatagttaaaatacatataaagtaaggcagatagttataggactttgggcttgtataatatcaatattattttcaaattttaagtaagttaatagcccagagctcagtggcatagaatacctagtaaacttaaatgaaatatcaaatagacaacaagctaacaaatctagtccattttttaatcataacaaaacttgtggcaggagtcaagtgattcaaggattctactttttcaggagaaattttgttcctcagtaataaatttgtccattgtttgctgtcagaattatttgcatgagtttctcaacatacagatgtttttataactagtaactcagcttcgttgatggtgtatagttaatactttttatagttttctatgaaaaacaaaagacagccatgagagtgatttacatatatttatcctttagatgcttagtgattgtctttcaactcctgaccagttgttctttatcacataaatcagggatccactagagcacatatctttcatttataataccatgttaatccatttgtccatgtaaaagaaatttttaaaaatggagatctgcagatctgcaattgaatttgttaaagaattcaagaaacacttctagaagattttcagattcccacatgaatcagagtctcatggcctcaaaaaaatgaatagcttttggagccatgcttctaacaatttgtaataatctggaaggtgccatggattgaattataaacttgtcatattttaattagtggccatggaattcaaagacttgctgcctagagactgggacctttttattacttttttatctttctttttttttcttttctttatttttctttttctgttttttttttttttttgaggagtcttactctattgcccaggctggagtgcagtggcacgatctcggctcaccacaacctccgcctcctgggttcaagcaattctcctgccttagcctcctgagtagctgggattacaggtgtgagccaccacacccagctaatttttgtatttttagtagagacagggtttccccatgttggccaggctggtttcgaactcctgacctcaggtgatccacccacctcagcctcccaaagtgctaggattacaggcatgagccgctgtgcccagccccttattactttattttttactgagttattgagatataattcatgtggcatgaaattcactcgtatacaattcagcaattcagtggtttttaatatattcatagagttatgcactcataaccattacttaatttcagaacattttcattaccccagaaagaaggccctacgcattagttgtcactctccattaccctctgccccaagcctctggcagccattaatatactttccatttttatggatttgactatcctaggtatttcatataaatggaattataaaatatatggccttttgtaaccaccttctttcactgagtataatggcttttaggttcatttgtgttgtgacatgtcagcacttcacttttttattgccaaacaatattctatgaatataccacattttttaaaagttttattattaatatttttgactgacaaatcataattgtatacatttatggggtaccatgtgatgtttatttggtttttgtacagtacaatgttattacctatgattctcatggtacattcgatctctagacttgctcattctacatgatgctatttggtatactctaacctacatctcctcattccctgccactgccaaactgtcccccagccctgtcactggtaaccacagttttgttcactgtctgtatcattgaatttttattattattgttatttatatctcacaaataagtgagatcatgcaatgtttttctttctgtgtctaatgtactacacttagcataatgtcctccgggctaatctacattgtggcaaatggcaagatcctgttcttttttagagctgcatagtatagatacacacacacacacacacacacacacacagacacagagattatggtttctttatccattcatccatctacagacacttagattgtttacatatcttagctattgtgaataatgctgcaataaacatgggagtcattttgtacaactcacgctacccaatcccgcatccatgtatagcttctctaggtattaggttgaaccatttgaaattggcattttgtaggtaaaaagtaatataattttatcattttgtatatctaagactaatgtgctgattatgacactttttgtcttttttgaccaaaatatatttttgtgtggaccaactttgttggaagagaaaatgtcatctatagtaaataaggcaaaacagtgttcagtgattttggatatcatgataatttgtaaaatacttacacatctgcctatttgatttagaataacaaactcaagaatactaggggaaagcataagtattatttctattataaatttttgaaagtacaaattttagtaagtgtagtcatatctctacaaaggtcattccaaaatattttggccatgaggcagcattaatttgtcaaattttattttaaaaatctaaaaattataatttagcacattttaataccaagagaaggcatgatttatcaaacaaactctttctgagcatttaaaagctgatagccccatgctaggtactttgcagaattcaaagagagtaggagacaagtctctatttaaaataaatttacatcctataatagaaattataaaacatattgattacaaaatatatggcaaggaaggccgggtgcgctggctcatgcatgtaatcccagcactttgggaggccaaggcgggcggatcacgaggtcagaagatcgagaccatcctggctaacacagtgaaaccccgtctctactaaaaattcagaaaactagccgggcgtgatggcgggtgcctgtagtcccagctactcgggaggctgaggcaggagaatggcgtgaacccgggaggtggagcttgcagtgagccgagatcgcgccactgcactccagcctgggcaacagtgagactccatctcaaaaaaaaaaaaaaaaaaaaaaaaaatacatatatatgtggcaaggagtcgcttacaaataaaaggcaatatttttaagaaagactgaatatatagaatagggaagacaatatggaatacaaaaacttctcttgtgtttagacattccaattcatccactagtgtgatttttcatattcagtcatttaaaaaacatgtttgagtgccagtacgctccaggcactgttttaggtgctttggataccagtgtcccaaacatgtaaaaatgactgccctcgtggaactagcggggtgaagttagaagtaaataagaaaagtttatgctatgataagtgctatggaaaaaagtaaaatgcagcagggaatgaaaagccatggaaagggcatggttgcaactttcattatggtagttaggaaagccctggttggaagatgatctatgagcaaaggctttaaggaggtaaggaagataagtctccattattcattcctggagagtttaggtagtcatacacaaatacgcagaccaatatatttagggaatgaaatcaaagttatttcagaagaggcacaggggtgaattaactaaatttgggagtatagctaaatcagattcttaaagatcaggcatctacaatgaagcagatatgacagaggggtggagtcatagtatctcatcaaagtgagaaaaggaagtgtgaagttaggtttctgctaatttatttatttatttattattttgagagacgaagtcttgctctgtcgcccaggctggagtgcagtggtgcgatctcggctcactgcaacctccacctcttgggttcaagagattctcctgcctcagcttcccaagtagctgggactacaggcatgcaccaccacacccagctaatttttgtatttttttttttagtagagatggggtttcactatggccaggctggtttcaaactcctgacctcaggtgatccacccacctcagcctcccaaagtgctgagattacaggcatgaaccaccatgcctggccttctgttaactaatttattaaatgaagtgtcttgaaaaggaaatcctgtttcccactttttttccattcccagaacctgtaaagagtctgaaaaatatgtatgtgtgccatcacaattgattgaatggatgaatggtggtaatccaaggtctaaaatactgtcagacagaagaagggtaaggcaagcatcagtttaggcttttgggcataaatatgaaaaatctaaaaattcacagaagtatctcaattgtcggttgtcttgtattcttagaatatgacatacctaagggcagtaattatgtttcacatatggtacttactccatgttggaaacaattgggaaaaaaagaaaagaaaaagagtgtaccaactcattctcatgtactgaactaggtatccctaaatattaaatgacctccagagagtattaaatgtttttggaagctgtgctatttttttagactgaccaggaccctgttatgtgctttcatgatagaatatgattcatgttcccagacataagtcttaggcatcattttttatgttcagaagtgaacagaagacaatacattaaaataaagcattcactttgaaaaatcacctcattatccaaaatcactgaagaaaaatagacatttaacagggagattatatttaaaggggcatttttttttttgcgggtcgggggaagaattctaaccagtatgtaggattcactaaaacctgaaatctcttgtgattattacctgtggtagtcatacattttcaaaatgtgatttattcattttatagctacatactggggagagaggatgatgatggtggcagcaactgtcttttagacatcaaaaaaagcagtatgaccctatctatagatgagttaatccaaaagcattgaatcatataaactgaatattgaaagaacagtttggaaagaaaataaaaacagtaaaatatgaaggtcaaaattctagccacatttactgagtagtttagaaagattttaagaaattttgcgccctccagtggttgttttggaatgaattattatcattattattgtaatttttaattttacctgggctttccattttccagcttcattgtttttggtaacccaggaaagtttaacttgtctatacctagaaggtgccttgggagaccgactcaatttgattacccagttttatgcttgcagaaataatgaggccagtaatgataagagtgcctagtatgtaatgatgaagttcaggctcaacaagataggttcacaaaagggcaatcatgcttgatttatctgattgccagactggaaatgaaagaaaagcagtgacataattaccccagattcctcagacctcaaatacaatccagcacagatatttgcaaaagtcttcagaatgattgcaatgcattttaaagagggacatacatcactgctgtagcaaatacaagaaggtttaaaaaatcaaagacaaaggatgtttctggaatctgtattgcttgcaaacagaacaaaagagagcagggaaagaaagtcacttggtgagagaagaaaggcagaggattgaatcaggaaacgctgcgggtgcctgggttttgtgaccttggtcatattctttgggcctcagctttctcacctatgaaacaaaggatgtggactaggctaagtggttccatgaagccagtatttggatagaggcaaggggtagcagaattgatctcatacaaaagaactgtagtttgaatatttatgaaagcaaaattagctagtgattaaaaaatggggcagaaaggtggctcaaggagaatgcaaatttatcttaattcaaaatacagtataaaactgatggaggcgattctttcaagaaggaaaaaaaaaaaaagaaacatatcatctgtctctcaatttccttccctgtagtctcattctctcttctctgccatcatattttttttttcttgactttctgtttccagtaaccatggtgatgcttcttcccagcaaccttcttcacagctggcctttttggttctcatcgaattttgctccattcactggttcaggttgctaacaatgctgtaaaaattaacttatttattgacatttttctccttcccttttccccaggaaataaatgcaggaaattattccacacttaacctccctacacaagggcactgtaaaatagggatattcaactgctaatttcagttgctaacatggaggggatacagattatgccaaagattgaattctctgcctgggccctcagggactgaaaagccccaggaccaagctggttgccacctccttttgcttttgtatgtaaatagattgcccccagaaatcacatatcggccctggttttctaattctctgttttttttttttctttttctcttgtaaggaaaacatggccaagtgcataattataactgttaaaagggtattgaattttctgtaggaaaatatacataaatatatgcatttctttaatgaagatatttattttggaatataaataagcaatatgcgatagttaaaaatattgtaattatctgccaatgacaaaacatcaacaaatctctgatgtccttaatgcagataataaaaattcccataaactagtatttagtcatgtccagtttgtgtagcttaacttgtttgtaatcctatatgcctgaaaactgtttctctatttaagcggtgtgtgtgtgtgcgtgcgtgcgtgcgtgtgtgtgtgtgtgtctggcattaacacaaaggagaccagatgatgacattcataggctgatagactcgactcctggggacacacttggatggaggcaattaaaatgcctgtcaggcatttggtaccagaagcccctatggcaaaccgctaaatcgtaagtgagggctgcatcctattgtcagtgaatgatggcggagctgagtggcttgtcatcattctcgaaaattctgagactagtgagctctctccctctctcccactcgccttattttcctgttcgccactgcggggacttctaatttgcagcttccctttccccggcacacacagacacgagctggtggcttgcagactgcgtctgtctggagctagagagccagagagccagcctgtggggataatgctcccggagaaggattctgcagcagttctcaaaggctagacttgagtggtattgctgcatatgcgctggtaatggtttggggcttttaattttatttcgtttcattttcaattcgtttttcataggatgtgctttatgtaatctcagagtaaagatcttttaaaattcattattgagcttcctaaatattcaagtactgcattttttttgtgctacagacctccaggcatagatttattatttgagtataaagaatgcatttgcttactggtgagttataatttttgatatttagttaacaaatccatatatatatatatatatgtttcttttgttttgtttcggtagattcttcagcttgtctctaaccgaggaagcattgattgggagctactcattcagaaaattaaaaggtaccacatgttttgtttggatgttttaatgagggaaaatcaggggagaattggaatgtttttatttaaattaatttatctatgattggtcttttatccttaagcttaagttgatcattgtctattgcatataccattttctatgcagatacttctattatctaaggttgttttgattagaggatgactaaagaattgtgtcttttgcctatgttgcaagttattaacaaatatcaacatgtttggcttatttggagattttatcattgtaatgttttttttaaagtccaaaattctccatctaaatgaaaattcattaatttgaatttaagagaaatatgctaagtaatgattttatctgaacaaatcctgctaagtgatttattaaaatggttaaatgaaatgccttgcccttcccaggtagaatgggtgctagagacgaaagcccaggaatgactcagtattgttggctttacaaataaaatattgtaacttctttattgacatttcagtctttaaaatggacatatttaaaggccgaggttgttagttcttaaaagaagttattttacatttgctttatttggaattgacagcataagaaagtaatccttcatcttgccatgaatgcacttgaatccacttgatcctgggcctcatgccttacatgaaaaacattaattttgaaattcagcatcaggatatatattgatttgagatggcaattatggatattaccttttctttaagaccgtctttaactttaatacctgttaatatcaataaaacctatatttgtaatttgcctttaaaaaatggaagacattttctgccctgctgagaagaaaatcagtaataccttttaagcctttccttgggatctatgtataatatttcctctcaagactgtcagtccgaagcattttacacaataaatttaatttttgaaaaatatacctgaaaataatgtccaactactgacactgaaatattataagtatgtgagtgtacacctgtgagtgtgaatatttgtagcaggtgaaggagagtaatacattgtcctttgttaatatctgcaatgtataatcatgagaaccttaatttattcattccacaagcacttcttaagagccttgctgctgtgggtaattattgtgagagagagagggaaggggtagatgacactgtcctcagccttctagagtgtaggcagcatcacataaagatttttgaacaggagaatgaattcgttaaaataaattagtgtggtctgagaaaggaaattgcattatttcagatattgaacaaaagctaatactagtcttgagacacataaaattatattgcacttcttcttcagaaattactcagtggaatcgtgtatgaaatcccccaaacaggattatttcacctagatattgtaaaactcttgagaccattctctctttttagatttcactcaaagtaagtgaaaatatttatgtttggtggaaaaaaaatctatttggtatttgcccatctgattaaatccagagagcatatatttcacatgaagatctatttcctaatcttcagactcattcagcaactcattatattaattttgaactttaggatatgtgtatgaattggaaaagggtgaaattatttaactgctaaaaaatgactccaatgcgttgtcaataggaactaataagttctgttatgatttgtctggatattggagaaggggcatacaatctcaccaacaggcctctggcatctaaattttggaggaccagttaaaaattcatctagcggtatgctgacaaaatgcatataataaaaaatgagtttattaaaatagtaggttgggtgattaaagcagaacagaatttgactactagagtcaaattctgggacctatatcatggtttttctagtcaatattgtggtgagttaattcctttactgatttcactcatttttttcacttacatttttaacacatagtatagtgcctgggtcacagtaggaattcaataaatatttatttaattatttcacaaataaatgaatttgtcagcattttcccctattacttttttgttcttgcctttcttaaaattatacactgtgaaacagacatctggtcattttttttttagttacccaaaatattcattacatgtttctaataaataataattagatcattacactggatataaaagtgacaaaccatgtatagaaatttctttaggctgtacggaataggatttttctggttttagattaaaacggaaagaattcttgaaatgtcccctttcactttcatcagctgggggaaatatgccaaactgcagcctgagctttgcttatggacgcttcctaaatactactcccaggcttgacattgtttattgcttttcatgtctttggccaagattttgctgcagcaaaggggaggaggcctttccccccatcccctttctataaatgtaatatgagaaatgatgtcatacttaccagtccataatgagcaacaaagcatttaaggatagatagatagatagatgatagatagatagatagatagatagatagatagatagatagatagaatattttctgtatatttaaggaatctatcaagaaacttctagaatcacatggctttagagaatgttattctttcttgctgtcatttattttcattattaaaagtataattttttgttattaacaatgtgacggacagtatcctaagtccttaacatatattatctcctttagctctccctgtaatcctgggagataagtgtggtctccattttacagataaatgaattgagactacagttgggcaaacccaagtctggcctcaaagtccttcatattaaacactaaattttaccacatttttttctagcagatttttggtacctagtcattgtcttgatgttccatgcaataaggttaaaacagtatgcttgcaaatatcttgatttatctgcaagtataaatcaaaatatctctatctatctatctatccatctgtctgtctgtctatctatctatctatctatctatctatctatctatctgtctatcctatctatctatttatctatggtagaagtgaatatgtcctcaaatacttaactaatattcaagctctattgtattttaatttttatatttaacttgaaggactttattcttcaaggatgaatgtcaaagataaattaggaagttttaaaataaatgtattcataaagcattttccatgtaattatagtgaaatgttattttgaattgcataatctatataagaaaattagagaatccaagtgctaaatagcataactgatgttataacttgcaaggtttgggttttttttttctttttaaagtgaaataatggcagaagaatgttcaagtgaccaaaataaagaaacaagcaggcaacagggccatgggcagagtaaaaataccaattcaacctcaaggacaactaacttggaaaaatcactgaagatactaacaattacacaaatatgtattaagattctctacttgcaaaggagtatttacaggagaacatttccggagctcagttggagtcagcaaaataagatgaggaagtagtaccaaggctcactggtaccgtaagagagacataaatgattttttttttttcagattttattttagattcagagagtacatgaaggtttgttacctgggtatattgtatgatgctgaggtttggggtatgaatgatcctgtcacccaggtactgaggatagtactcaatagttcattttcaactcctccttccttccctctgcgctttagtagtccccagtgtctattgttgccatctttatgtccacaattaccgagtgtttagctcccacttataagtgagaatatgcggtatttggttttctgttcctgcattaatttgcttaagataatggatccagctgtatccatgttgctgcaaaggacatgatttcattctttttatggctgtgtagtattccatggtgtatatataacatattatggataatttattaagggacttcattacagggcatgaattctaatcattggaatgggactcaacaggaaatacttcatagagtatgagttttctgaggcggaacttggggatgaatagaagtattcaagggggagacaacgtatggaggagctccagaaagaacaaacattagcaaaggaatcaaaggaagtgaacatgctgggaaagcacagactgatctcattcatattctagagtataaagcagaaaaacaggactcttagaagataaagttgtatcatacgaaatggctaatattcatcttttttgaattataaaattagaaaatttcattcagttcaacttaatacattgggagatggctttgaatgccagtcaaggaggtttgtttcttattcagtgggaagctattgactagtttgagcaggagactactatgaccaaactgtgttttcagattatttgttttatagctctgtgtgagataaatcagaactgtgtgtgagagcatgttgaagaaagcatcacttcagaagctgtcatagaataatcccaggggaaaaacaaaagtccaaagagggtattgactgtgggcatgaaaaagaggtcatgataatgaaagatgcttctgagctcaagttcatatacagagtagaacaattgcttgattggtaggaggaatgaacagcagaaggactcaaaggtgactctgaaatttgaatctgataactgaaaaaagcaaagggagaaagtagctgagagctacacgaggaaagagtccttcttttatttttattgtatctctagtcgctagcaaaatgcctagtacatagcagacagccaataaatgctaaatgaatgagtgagaacacgaataaaaaatgaagaggtatgtttaggacatgaggctggatatgtgggtggactgggctcgtagattgcagaacatgcagatccaaagctgagaagggaagtttagggagggagggcgtgggtgttattaacaagaaggataagaagaggaccagagggaatctcttggcagtacctgcatttaagatgcaaaataagggacaagaattaaagttgaatgaagaattaaaaaaaaaaaagcaaagaaagaagaggacagggaaggttatagaaaacaaagttaaaactcaaattttccagaaaaactgaagaatgagaataaagaaaatgttgctgggagtattatttatttcaataattattttgttataaaaacaataaatccacattttgtaaaatttgtaaaatttagaagggtgtaaggaaggaaataatagtcactcataattacacaatccagagattattgttaacacttttaaaacattttgatgtattttttatcctattgcttttaaaatttcataatcaaaatcataaggatataattttgaattctgccttttttcattcagcagtgtcttaaggatttctcacaacattttgccacctgcatattattctctcacctaaagtttggacattttaaatccctactgtttccagtttttcactatcaccataatgctgtagtggaatagtttgtatattactcttacacaatattttaaataatttccaatggatagttacttaaaacaaaatcactgtattctattttgtcaaattcctggacagataaaatttggtggtttcaaaatgagcctcggctttcctccaaggaggatctgagattacattagcacctgccatgtgccagcatctgtgaaaggcactttaattatcacagtatctctgatgtcgattctattatacccactttactaatgaaggtacacagactcagagagttgcacatgttttttaggcctagttttaaatctgggtctgactctaactagtcaaatcgtggagacacaaacaagatcttgagaaatgaatgagtaaataaggatatgaaaacaataggaaaatacacttaaggagtccggaactcaaagaaaagagagataaaatatgaaaagcaagaaggtagtgacttcagtgcgcttttgctgcttattaacatggaaaatcacaagccaaaggcaggggcaggtagagaggggtgctacatgtgtaatcagaaaaaagacaaatttatagaaaatgttctaaaggaaagggtataaagaacgtggacaagaatttgggcttggcatgcaaaatgtagcttccttataaataagagcaagggaaaagagggtgagacttttgaagtggtaaagaaaaaatatgagaaaccttgcatatctcatctggactttatcctggactgaaggatattcattcaatgaatattaattgaatacctaattccattcccgtttcctgcccttatggaactttccttctagagagtggaactaatcagtgggctaacaaataaaattaaaattactcaggcagctgttcagagaatgaattataaaagggtaagagtagatgctaagagatttgcttcttaaactttaaagcagagaagagtcaactggggatcttactaaaatgcagactcagagtcagtaggtctaaagaggggcctgagattctgtattttgacaagctcccaagtaatgatgctgctggtccatggagaccatgctttgattagtaaaaggctagaaggcaaatgtccaggcaagaaaaatgagaaatgattggaggagtggttggtgagcaagtctgaagtgagctcttcttattcagcaacatagcatacttttaaacctctttgatggaaagagcaaattgcctgtctactcccgagtttttaaatcccagccagttttatgaaaaatccattaaatcaacccaaatgagctactggcattccattctttctgcccattctcaatgcttattatgccatataatgaatttcggtggcttgtgtttggggacgtggttctatataaccctgtgtccgtttcttcattccagttctatttcctgcctcatgatttctttggactttaatgtcctctctgcctggatttccagtacagtactgagctgctaaattctctgtccccttagctcttgacatccatcacactcctctgtgggaagcttctgagtctccacattccatcctcttgccacccactcctactaaaagccccgggtgactctgcttaaagccacaggggaacagaagatagtctctgacttcaggaaagcatttttttttccgttgaaatcatctctttgtggtggactgttttggttggtgacagcaacctgcatccctctgagggatttgtcagaactctataggagaatgcatcggtgtgtagacaatcagagtgttcagaggagccaagtattcataagaagccttgacagactctgtcaggaggaatgttacctttctgcctccagtgctagaatgtaactctagtcatctcttttagctatgggaacgtgggagcactgacctgtttgattaccctcacatcactcattgtagctataaaatatctaagaaaaaaatcaaataaatataacatacccatccttcaaggcagagtagctcaagtgcatgttaaatatctgtggtgtcctcatccttattagcatttatcctttgcttaaggggctagttctctctctggaccatgccatgaccaggtctccagaccttgttatcattttgtaatttgttgtatacttaaacagccaaataggcatgagcaatgtccttagaaactagaaatttaaaattgcaatgaagtatcaaattagtttttatgtgaagtcaagttaaattgataatcacatttcctcaagaacacttaggcaaggtccttgaggagagaagccatgttaacaggcacctttgcactgtatatgttgtctacatagaagatactctagatgcacattcaagtcgaagctaagaaaaatgagtgttgtacatgggtgtgtgtatgtgtcagtctactctttccataatggacagcactggtcttctttgcatcatcaagctggaattgactatttgcagaatttgaataccatgcccatgcattcaattgttaagagtctcagagtagcacagaatcatctctggtcttccaagattgtctctctttctcaaaatagaagtctgagtaagttttgttttttgtttttgtttttgttttgttctgcaggttccatttcagtctgcctcagatggtttgcattaaccttttttcagattctctcctggtgttaatgactacattatgaccattttaaaaagccagatgtacattgatccacctatggcaattattaaggaaaagatactccatttaatgcattataaccaaaatatctttcttcaccacgtgtaggaacttaagaaatgatgtctctttttgggaagatcttacattttatttccaaggtgaacaatggttgtacttagttttctttaaaactattttcttgctttttatatgattttctcatggtaagatttcatgttaacatatacagaataaggtgaagcatgcaagcgttaaggattcttctgacatagtgcccaagagccaccaattaacataattttgaacataacttcaggaaaatttgtgatatttcagagtcttaaaaaaaaacctaagtagactgcctatactttaaatagtgggagcagaaattcctaaaatgattgactttccaagatgacatttgaggaaatatgagatctaacaatcgaaacattttaaaaatcatacaagaactcatgagcctgagaaattcacataattctggctgtacttttcctctgtaggaaagtggataatccaagagataaaagagaaataataaatgtaatatattacattaagcatgcaatgtttgcatgcttaatggaataagctccctatgttatgttcacaaacacaaccagggtatagactgtgaattacaaagttgttagaataatgcaaccagttaagaagctgcatttagattttaaggacaaaaaaaaataatcacttctgtaccacttttaagtaatatgaaacattttctaagacgtggtgttccaaagctcacaacggtctttggaatgggaaaggcagacattgttattatatttggtatagatgaaaatactgaagtttgaagaatgcaagtgtcctactcaagtcaatgcactagaaaatggtaaacctgggacacatatccttgttctgactccaaagcctttacttcctactactatgaagctaaagcagataaatgagtgtattgccctaaatctacaatattttaataatgcactgacttgattgctaaaataaggaatctaaggcagtggcgacctctactaagtggattgccctaccttaaaagactcctgcccttccaagtcttggattagtgtggcatggatttatgtaaatactagtaaaaatagcacagtctttactgaaatggtttaaaatttttcaacatgagaagcagataaagctaaatatatcacagaaaatgaaataatgaaatattattgatgtaaaacacatttgaaagaaggataaattaataattcattgttcagttctgagttccacagaattttaagcgaatggtaaataacgcagtaagaattcaggatagcaaagaaaattattaatgtttcaaaagagcacatctatggagaaacattttaaaacataggcattgtgatttgcctgttgttaggataattaaaagagcttataaagaaaaagtttaaactggatctcagttctggtctcagatgtagacatggaaggggaagaacatatataaagaaaatgatgacctcaggagctgctgagttagggtcaaggtggaggttaggtgtcctgaggcagacacccatgggaatgggtccaccaaggccatgctcagtgcagcgacccacctcttcctcagttctcctttccaccaccccatccatgctctcattagcacaccagggatactgaagtgtgtttatctggtctcccttccccaaacacatcactaccttaatcttccagacaaactagaacacccttcctattatttttttccccctttagtggctctcatttgctatctcaaacagtgttggctaataaatacggtagccactagccacatgcagctatttaaattcaaattaagaattttttttttgagatgagatttcactcttgttgcccaggctggagtgcaatggtgcaatctcggctcaccgcaacctctgcctcccggattcaagtgattctcttgcctcagcctccagagtagctgggattacaggcaagcgccaccacgcctggctaattttgtatttttagtagagacggtgtttctccacattggtcaggctggtcttgaactcctaacctcaggtgatccgtccaccttggcctcctaaagtgctgagattacaggtgtcagccaccatccctggcctcaaattaataaaaattttaaaaattgaaagttgacttccttagtcataccatgtttcaagcgcttgatagccacattctttttacagaacattatatattatattacatttctagtatcacagtgggtttgattgaagagtgctgctctggagcataaccagaaccttcacccaggcatcctaggcctaggcttactctcctccttgcccattacccttagcacacagtcttcactccacctgctactgtcctcctcttcatggtcattattacaattagaattaaaatagtaatgactcctgtttatttaatgcatattatatgccaagtacataccatgtttatgagattatgaaaaaacaaaacaaagaagcctcataagaccatttggtttctttgttttttgtttgtttgtttttgtttttgttttgttttgttttgtttttaagcttaatttcacagtagaggaaaatgaggtttagcaagggtaagtctgttttacaaagacaaagagctaattgtctgtggggcctgaaataaaacccaggtctgtctggcccaaagccaaggcttttcccctaacctgtgggcccctctgccggaagtcatttggaaatgtctggagacattttggattgtcaccactggagcaagagctactgacatctaatgattagaggtggccagggatgctgctaaacctcctacagtgaacagctttctgcaatagagagttatctggctcacaatgacaataatgcccaagttgttcgttttctatctccttctacaagaatttacagtctaaaaaaaataaaaatgaggacttttgtttccccaccacaattttcccactgccttaaacagtacttatcatagaataggtatatatttgaatgagagttgaatgtatcgtttttaagttaaagtaacacctacttatggtaaacaaataaaagtttaaaaacaagccaaacaagaggaccaaaagaaaatgaaagtcttcctctctgttcccattcccaatctcacatcccagtgaaaaccattttgataattgctattccccaagagttcttctgattaccattttagttgtaaatattatacttccatttcttaacttgggacagtatctattgatttactacaataaaaagtgagaaatttagcacactaacactttctccctctcccctctatttgttaggttattataatttttatattgtcaaggtttattatgaatgtattctgttctgtatttataattaagcaatctgtattttatgttgattcaaaaatattttgaatatattcaaaaatatatttccctgttgaatcaaacactgtaatcagaaccactgaaaagtaaaggtaatcttgtctcttcccaactcctgcttttcaagtgaaaatattctaagtgttgagatccagaggctttaatgccttttcaacctaatttctttcttctaaactgggttcagcacactttttctttaaaggggcagatagtaaatattcttggctttgagggtcatctaatcaccatcacagcaacttacatacacagtttctgtcgcagctacaatgtactctgtcattgtagcacaaaagaaaccatagataataagtaaatgaataggcacggctgtgtttcaataaaacattatttacaaaaacagatggtggctgtatttggcccacaagtcatgacttacttaccctcattttaggctatattcgtgtctcccagtgtcttctatctcatgttatcttttctgtatttccttttggtttgactggagctccttgtgaaaggcatttattcatatgtggccagtcactaataaatctgagtccttacttgttttaaactatatattcacatggtacttatacttgattgataatttgatcaggtgtgcagttttgctccattacattttagcatccagtgttattgatacattacattttagcatccagtgttattgatacgaaatctgaaataagtcaggttctcattcttttgtgaaatactttgatggttttctttttagtaggctttaggaattttgtgtgatttggaaatgatgtgtccagatgaaggtcttttttcatttaacctatttggcaatcagactatttttaatgatatctttttaattcaaaggaattgtggtttgctcttctttgatatttgttgctattctcgcctctgttctgtgcttagggtattcctaatgataaatatggaacttccagaacctataatgtctcctttttcaaatattttaagacattttttcactttttctccgttctaggttttttttcctttttgtcaactgaatcatcaactttacctttagtcctgctaattctatttttaaaaatcaattcaaattatgtaatcaatttaaattcaaattatttaggtactcatatattaatttccaagaattctttcttattttctgattgatacttttccataattcattttcaaaaggatgttcatttttaaagtatgtaaataacattctttcaaatctctctgagaaaaatacttgtaagttctctcttctttcctgaatcacctctatttcctcaagagtgatttttaaaatgtattgttattgtttgtgctgcttatttttctcaaatatcttgattttgaaatttttattttattaatttgtattttttaattaaaaaaatgaatgaagaactagttgaggatcataggtcgctgttgtaagttcctttgcagttgtgtagctgtgtatccccattaactgtgaaggctgactaatggttctaggtaagagggcagaatctgtcaagatgcaggtatcagcagcgtgtggtaactctcatctgtaaactcagcactttaggaggctgaggcagtaggatcatttgaagccaggagttcaagaccagcctgggcaacacaccaagaccctgtctctacaaaaaaaaaaaaaaaatatatatatatatatatatatatatatatatatatatatgtattataaaaaataatatatattatattatattttatattatatataaatatataatataatacattatattatattatatataatatataatataatataatacattatattatattatatataatatataatataatataatacattatatttatattatattataatatatattataaaatatatatttatattataaaaatatatttatattattaaaatatataagtatatatttatattattaaaatatataaatatatatttatatatatatacacacacatattttaaaattatatatatacacacacacacaaattagctggatatggtggctttcgcctgtagtcccagccacttgacaggctgatacgagaggatcactggagcccaggagttcaaggctgcagtgagctatgattgtgtcgctgcactccggcctcggtaacagatgaaaaaaaaaaaaaaaaaaaagcaggcatcccagagggagtatggagcaacagctggcaagctggcaatgagcagggtaagatctttgcacatccaccatgtgttttagttctgcctggatttatctgtattagaccaggttccaaaactgatcacatgctttcattaaagactagttcttattttgaagacgaaggcttcaagggtcaaatgtagtagcaagggagaagaagaagggtctcaaatgttctgaataagtttcttaatgaattgccatgatgttgctcccatagtcctctaggactctgtatttgattacgctaagcttggggtttcctcaggtttcttcagggtcctactattaacaaaacacgtttccctggtgttttttctctttctgtctcagcccgtctgcatttgatgtctagaatatcttcaaaatttctcctagggttacactgtatttttgacaattttattatttactgatacttaatagagagaagtgtgtgtaagaattctcctatcactgatcatatttcatattttttactctgaatattcataataacagtatatgtttgcactacaatcttttccacttattatttcattgttttacctctagtatttactacctggttggaaaaattcctttcctcggcctttattttctgtaaaataatgataggatctaattctcagtgttgagatggaatatacaagtacagattgtaagatgtagaatataaatgtcaactgtctttatatataagactttctcatggatccagagtaacaagtaaatgaagaccttgagattaactagttacaggataaccccttccctactgaataggaattacaaggtgatcccaaggagaggcaagaagtaaaactccttctacaattctaaagaactagaaattatatggtggtagcagtattaaaataagcaattgcacattggtatatttttcacctcacagaaagacaaagttgaaagcagaccaagaatgtagttaatagactctcagctaagtaaaaataaatgtgaaatttaggtttggcggtttggcgtagaatatatgacttaatgtgtgtgatccttgtcttggcaatattaagaatatgaatatttatgttaaaatgagtataatttagtggtgctaattagctgccacaaaactattattgattttatctggcttcagttaattgaaagtttctgctttctcagtgagattaagacatgaagcacccagtaaaaggagatactatctcacaccagttagaatggtgatcattaaaaagtcaggaaacaacagatgctggagaggaggtggagaaacaggaacacttttacattgttggtgggagtgtaaactagttcaaccattgtggaagacagtgtggtgattcctcaaggatctagaactagaaataccattggatccagcgatcccattactgggtatatacccaaagcattataaatcatgctactataaagacacatgcacatgtatgtttattgcggccctattcacgatagcaaaaccttggacacccaaatgtccaccagtgatagactggattaagaaaatgtggcatatatataccatggaatactatgcagccataaaaaaggatgagttcatgtcctttgcagggacatggatgcatctggaaaccatcattctgagcaaactatcacaaagacagaaaaccaaacactgcatgttctcactcataggtgggaattgaacaatgagaacacttggacacagggcagggaacatcacacctcagggcctgtcatggggtaggaggcagggggagggatagcattaggagaaatatctaatgtaaatgacaagttaatgggtgcagcaaaccaacacggcacatgtatacctatgtaacaaacctacacgttgtgcacatgtaccctagaacttaaagtataattttaaaaagagaaagaaaaaaaagaaaataaaaataacagtaaagtgacttcattgtaaaaattgaagaggagactaaatgtagagagaaagctaaggatcacagtggccttttacttcaacgtactggaaaccatttgcggatatgataaaatgtgtattttccctaaattattaaaacacagcatctttattgatagcctttattcttacgaataaactgaaaacacatcaaacagacaaagcacaccacgtgaatgtatgcagcatgatgcatctacaattagatatatgactgctattcattcttattttctgcatgcagttattacattctaacgttgactatttgcagaggataagtcgccagccctagttaaatgttaatggatctagtgacatgacatactttaaattcaaggccttatgcaaaggaatgtgaataaaatgcatttgtttggctttttatggccactattaaaagtaaaggaaatgaaaccataaacaactatgctcaaatattggcatagctgaggctgctttgttgcagtagaaaatcatatttattgatggtgaagctctgtttaacctacccagcccatctggatggtaattgaaattttaaaatgtacttggagacttaggcaaaacatgaagcgctaactcaaagcgagttcattttgatgtgttttaatattctgttgttgcaaaaagctggcacaatttacaagtcttttttctaactcatacctaaagccaataattaatgtagtatagattacttttgcccccagtacctattatctctttattcctcagtaaaaataggactcctgcttttgggagattcatgggtagttggccattcagaaaaagatccagaatttcagcctcttttgtaactagctgtgaccatatgactaagttctggcctgtaagctagaaaagaagttttgtgtgaaatgtgtatcagctacttaaatggagtaagtgtgctctttgccacttcttcctcctttcttctagtgggaattcagacttagtgactggagcttcagcagccattttgaatatgagataatcttataatatatttctattttgtttaagccactgttaattggggtttttccattacttacagccaaacttaatcatctgtttgacaattttataactttatgtttattttcaaagattccaaaccatcatttcatcatcatttctctgtatataaatcacttttatattaaaattgttaccaaaaatataccaatcagttaccaagttctattcagttccactttctaaccagtcttcaaatccattcatttctttatgctcacgtgaactatgttagctccgtctctcatcatcttgaactctaatgactgcaacagcttcctatatcaacccttgcttcacaggcaccattgtacacatggtagctggacttagtttctcagaatacaatctaatcatgatatttctgtggttaaacctttcaatgcttcccatagcattcaccctaaagtgcagaataaactgtgccataaggccatccatgatctggcctctgcctgactctctaggtccatcctgagttgatcttcctgcagctattgcattttttgttttttttgttttcgttttttggcctggtactctctctctatgctccctcccatctctccccactcccaccctcctcccctttgcttactgaagtcctgcttattggctgggtctcagattaagcctctcatcctctgttctgatttaggcttgaccattatatactttcagagcccctgtacttctctcacttatatttatcagattaatgcccatcttcctacaagactagaatctccatgagtgtctgtcctattcttttttatttatttatttattttttttgagactgagtcttgctctgtcgcccagtctggagtgtagtggcgcaaccttggctcactgcaacctctgcctcccaggttcaagtgattctcctgcctcagcctcccacgtagctgggactgtaggcacccaccaccatgcccggctaatttttgtatttttagtagagatgggggtttcaccatattggccaggctggtcgcgaactcctgatcttgtgatctgctcacctcggcctcccaaagtattggtattacaggcatgagccaccgtacccagccttgtgtctgtcctattcttaacttgaaccccggcacccagtgcagagactggtacagaataggtgctcagacaatgttgtcgactaactgatactttttttaaaatttatttattttatttatttattttattttttattttatttttattttattattatactttaagttttagggtacatgtgcacaatgtgcaggttagttacatatgtatacatgtgccatgctggtgcgctgcacccactaactcgtcatctagcattaggtatatctcccaatgctatccctcccccctcccccaccccacaacagtccccagagtgtgatgttccccttcctgtgtccatgtgacctcattgttcaattcccacctatgagtgagaatatgtggtgtttggttttttgttcttgcaatagtttactgagaatgatgatttccaatttcatccatgtccctacaaaggacatgaactcatcattttttatggctgcatagtattccatggtgtatatgtgccacattttcttaatccagtctatcattggtggacatttgggttggttccaagtctttgctattgtgaataatgccgcaataaacatacgtgtgcatgtgtctttatagcagcatgatttatagtcctttgggtatatacccagtaatgggatggctgggtcaaatgatatttctagttctagatccctgaggaatctccacactgacttccacaatggttgaactagtttacagtcccaccaacagtgtcaaagtgttcctatttctccacatcctctccagcacctgttgtttcctgactttttaaagattgccattctaactggtgtgagatgatatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatttattctcttctcttcacccaaaaagcatacctaactgacatcccaaccaaggttccactcatcaaaatcccatccatcctctggaccatcaaaaccatgtttgcaccttctccttttaattaggcattcatttttcttgtgatcatatatcagactttaattacagttattttgtttacaaaattctaaattactattgggaacacattctagaaaattcaagtgttttagaaaagttttattataatagctgcctgtatttaaaaaaccatttattacaattgccttcttgtcaacagaacagaaatttctggagtctatggctggtaaattattccttttttgcaagcagaatgtctggcatataacaggcatttaacaaatattgagttataatgtagtggaataataagtccgtactttgaaattggatacccttgggttcagatcctcatcaactgtgaaatattggaaatttaccacgcctcaggtgtataaaacaggaatgataataaaaaacttattaggatattgagggggttaatgaagataatttacagagaaaaagttatataattagtagtaattactatgatcttccaaattacattactctactcccttcttaacaaacaaggtaggtgctcagttctttcttgatgttgttttgaaactgaatggtaaagtttgataaagacaaagcctatcattaaacaaaagctaagacctataaaaggagcattgaagggactgcacagtttcctttactctgcccctttgcttctttctacccatttcactcttacccaaaataaaaacaaacaaaacaaaaaaagcccacacacatcgacaggtgaaaagcagcaagatgatagatggaactgtatattatccaaagtcaccagaaaggcctggaaattatatacaacctaaattacaccacctgaggccattcttctctcaggagaaaagctggcaggggcaatgttaagagttcagctgtttctcttgaggtttatctgaaatgcagatttgtccaagcctttcctagctgttgcagcctccagacccaccagctgctgtcagtccccccagctggcttaataggatttgtcttctctatagcctgtttccggggctgtctaccatcagcacatattcgggtagacagtttttccccctaactagtgtcaaaatccctaccaatcccccaaatggcaaagatccattatcacctgtctcaaagaaaggattattttttgtgctttctgcctctagccacatacatagatgttatcttttgtaagagtcctcagtcagtccctattaagggcaaacctccttgtagggctgacagagccaggacacggtgagtgagctgggagtcagcggccttgaatttgcaggcttccccaggtgttagcgctgctaggctacctgatttcaaatgcttcccttcttcttctctataggagtaatgtctattccatcatttgagctaggattgtgactatgtagcctttcctgtaggttaagcttacactttctttacatgcacagattcttgctcagttttttatggctaagcaagacacactgttgagaggctaatagcttgggtcagttcaggattagacttctcacaatgacagctgtatggctcttgtcaagttgctctgtaggcacaggtttctcaccagtaaatttcaataatacttacctcatagacttgtgaagaatggttgccatattgactgtaaaatacttagtcaagtgctaggcacttcaacatggacaataaatggtggctggtattctaattatttacggttatacttacatttaaaatttttatttttatttagtaacttaaacattatggttatgcgtagtcaatcctttcagtttttattcttttttctttttttcaagttataataatgtaggattttatttttagaacattttcatgaagaagtatctcattcctttctacatcttacataaaaataaattctcttgttaggcttaactccaaccatatttcacactttaggcatgtgaattttttaactagagagaaaaatactgtgttttaaagatattgaatagtctttgacatggaaaacatagctttaatggttcattgtttataaagagaacttctataaattatgtctgaaatgcagtgagcttgcaaatcaataggctataaaggggtggtcctgggtgtttttatttctttagtgttttcctcttgtgctgccagtaacttaccaaatgcataaatgagagaaatgctaatttattctgggtttcatcagtaatgattcttgagtctactacaaatcagttcttgggaggttgaatcacatgggttggcagtgtatttttctgtgatatgcgacatacagataggataaaggatattcagcattctaatctcccttgaaggagtactacttatatttttttaaattaatcttgatttttaaagtctcaccctttgtatctacaaaataaaagtaaattgccaaaaagactccacttaatgacatttaagaaaggaggctgtttacttgtgtgatatgcatgaactcttccaagcttcaaggtctgttttaataaagccctctttgcacagacattatgtgtgaaaagtctcccaaactaatttatgcacacctgactcaagcaaatactgttgttgttgtttttctaaactgcttgtcaccttttgaattttatctagtttggaaaggaaatcgaccaatatgccttagttttttagttcgaacaagactcaactatgcatattctttttatatttctctcaaatggaacaaatcaattctcagtcaaaaagaaaacagttgagggagttcatttactgtttgggttaaaaatataattggcttaaaagacaaatgtaaaaactattaggatttttctcttcaaatatatttggatagaattaacaaaggatgcaaaggtatacttggctacccatccagtcataaaataagtgctgctgatcatgaattgcatttgatttcacatgcttctcctcaggcaggctggcagtcaccttggcctcttttagctgtcagaaggattgagccttttgtaaactcaatagattagaatcccagcactttgaacagctggtgtaaataggaacacgaatacagaaatatattctaagtttctgttactaatcttgatcattaatatccactaccaataaaaagtacacattcacactgtgaatctattttgatgaactcagaagaagaggagccagctctcctgacaactgaaagagaccaagaagactcaagttcttctgagaacgctagcggattctgagcatgccaaaactggaccaactctccaacagagtttatcaaaatatgaagagctgcctgtgggccttgcggcacttctctaagtcaatattacacattataattctctaccaaatcttaaaatggtttcagagcttgtactgttatctggaaataagagctaggcttcaaagagatactttggtgactgcaggtctccggtagtcctaggaggaaggctaatgactctcaggcaggcatctcaagctcataaatcagtggcttgaagtgaagccatttagaatagaaaccaattaaccacaaatatcaaaaagagataaagcattcataagaaagaggattgccagctgtgcacagccatgttttcatttagctgcagtccagagtcaaactgcccttaagcttggagagaagaatagttgggtgaataggattgcctgtccaaactgacctgacgcccacaaatttagggggaaaagaaaccccttggtttatttagaactaaattacactgtggaatctaaaaaaatatgtaggcccagctattattttttctacctaccatgtttcccacgaaagataccttagaaaaccatgacactcactgataatcacagataaagctttaccattttcagtgtgccttcagagtcattgtttcatttgatgtagaaacttcggcggtgggatggggggcggttatcacaaaggattaacagattgtgcatgaacaatctgcccccagtgatgttccatttaccttttatatgtagaagaggaaagcaggcacggagtaaccatttaagcaagcattttcaaagctttctgcatgctggtgggcagctccttttactcaatagatgttaatagctaagaaggggttactcccagtctttaatccctgtgaggtgtgagatttctcatctttttatacccgcctttcttgaccacataacagaatagccatgacttttcacatttttgacagaatatctctcaatttttggaatacaatgctataaaagacatctttttaagtaacagtttcagtcttttcatcagaggaaagaaaccacaattgctcttagtggtttcaaagttgatctaactatctaagggctgtatgtgctctggtagggggaaaaaatgagaaaagtttgtgtaatgccaaggtaaagccacagtgtcctacttttgctgatcggaggaatgtgcaattgtgtggagggacattgcaaattctagttagctgaggattctgccttgctgacccgcagcaggtcttatcatctcccggaggattttgttttgcatcctgtgtgtattcactagtttgtaccagtttccattaatttatccatgagattcactggatctctatagcagtaagaaggattggtgccaacaagaaggctatagcttagggtagggcccaagaaagatgaacagatttttagaatgtttgcatttatttaatcacaacttcaattcagttttccaagtagttactgaggtgttcattaagtccgtacccagtacccttgaaacaagaatgccacataaatccttgtcttaatctgcactaatccagatgagctaatttggtagtttggctctttagttccctaaagtgaccttaacacagggtgtacagtgccctatctgcataatcatgaattgtagcaaaaaggtttttgctcctggtctaaagaaactcaccaatattcattttggtgatacatttgttctctaatatgaccatcagcagttcaaatgtaattagaactaagaaaagggatatcctcttaaatgtaaccaccttgctttctcttcgaagcctttaaaaaggatttctgtaaaacagtttttggtattttaaccgagtaaccctacagtaacagtctgttttatggaggtcttttcaaattgtacacataggcaggcccaaaccctgcgcacatgctttttgtttgtgcagagaatgctgttaagttcttttattgcttaagcaagaataacaaataattatcctgccataaaggaaaatactgataattatagtttgccaagcatgttgaataagcggacaggaaagacaaagtgttagtgttggcaaatcccaaaacagaatacttctgcagaccgaaataaactcccaattctaatggcctccccataaaaatgctaaaaactttagaggctgttgaacaaagcctgatggttatggtatattatatgtaaccacagagatgaagattttaaacatagtcagtaatttctcactgtgttttagttagtgcagcagaaatatactaaaagagtatatgcgtgtgtatgcaaatgtgaatacatcagatctgaaaaaaatatttatataaaggtaactaggctgttttagaaaacaattttaaaaatacagtttctcctagctactgttcattagtagtcctctcaacaaacgtatttcagtgagactcatttcactatcttagacagttttgtgtgacttttaaacagcccttatggaaatagatttattcaaaattagatttttggcagaaaatatgtacaagagaacctcattatctactaataattgttgtcacagaaggaaacatttaaagtaaatcttcctcaaacacagatcaagttttattaaaaacatagtgaaggaaagttggaggcaatgtttagtttgaaaaaataaagttagatcttataaaaataaggttattataactatgaatagaaatgcttgtattataattgcaactatatgctcattctaagacaaaggaatgaattgagtttgtttggttttattgagagtaacttccccacaagttttattagaaggtagttcaacatcctttatgccacctttggctttttcagcatgctccttaaaaaggctgtttgggtaaaaatatttaagcacttactcaatttttcctagattttaaaaaactattgtgatacagaaataattatttgttaaagtgaatattgtgcccttatccttgtggttttccctttttcactggtaaccggcctaaccatgccagatcttcatgttctcatgatttgcctgttacttgagtacctctcctccattgccttagacttgcaatttaaattaacagttgagtggtatcccatttgtgttgtgttgtcagatattagcatcttctgacaagtatctggaaatcaactcaagaggaaagaccttgaccttttgagaaagggtaaagttagtgttaaccgctggatagatagatgcatgttcatgtaaatacttattttataaatgatcagtttttttagtgactatgttcacgttatgatggggggggtgtagaaaaaaatttctccaatgtgtaaaataatcttcctcactcaaaatcgtatatcaagccttttctttaagagaacatccatttgattgataccaccagagaagactttaataaattgttcagtctttttttatttctggctctttcataaagttacttgaagactgtttctaaatatgtgtctatggttaaaaatataaaagaaaaacttccaggtgagactatttaatttttaggcactgtaaagggaagatgtttcctcttggtattaacatgtgaagaaagaatagagaaagtaggtcttgtggcttgcacctgtaatcccaccactttgggtagctgaggtgggaagatagcttgagcctggagataaaatttgcagtgagctgtgatcacaccactgtactccagccttggcaatagagtaaaccttgtctcaaaaaaaggagggggcatggaattggggttaaaaaatagagtagattcattctgtgggcaaagtctagtaaaacctaggtaattaacatctctctattaaattggacatatgaaagagctttagaaaaatctgtaccaatccattcttttgttttgatgacattattttgaatgtaataaataattatcacatttgatagttgagatcatgtttatgagtcatttgattttgcatatatgagccctgcttggagctaagtaactgcataattaaattttcatttaaaggaacaataaccgcagaaagtcaaaagctaactcaagtaacaggtggtaaatgtttgatatctgtattttaggtgacttcacagtaaatgaatagcattaatgatattaaatatatcattttctgttgtgttcctgttaatcttcagcagaaatatttattaactttaaatatattttgaaagtattttattgttaatgatgagaaaaactaatagcatctaccagttagtataataaggtaataaccacaaaactcatctactcaccaacatgtttctatgttatgatgtacatgtcccaggtacatttccaagtagatggcattctactttcaaatacacttgggaaccatataaccattggatactatttaacatttaaaacattttccaaagttgaaggtgttttgaatatttaaagtttctttatttcagtacttaaagaaacatagactgaaatactgggagaaacaactggttcactgactgcagaccaagatgaattagtcaagagataatataaaacttgagccaagggtcagttcatcccaaacagattttgaaagatggtaaactattccctccctctcagatgtcttcaaattaatgtttcatttgtttgtttgtttatttgtttgtttgagacagaggctcactttgttgcccaggctggagtgcagtggcacaatctcagctcattgcaaccgctgcctcctggtttcaagtgaacctactgcctcagactcccaggtagctgggattacaggcacctgccaacacacccggctaatttttgtgtttttaataaggacaaagttttaccatgttggccaggctgatctcgaactcctgacctcaggtgatccacccaccttggcctcccaaagtgctgggattacaggcatgagcgactgtgcccggcctgaatattaataccatgtggctgcctaccccactggtgtgcactattgctggatcctcaccagtgaggggtaccccttttactccagagtcctaattctgaaagccccagtcttaattctgctaatatttctaactaccactttcttattccttttgctagtcaaactcctctaacatgtccattcaatttattgtcttatatcttttctgtcacactcttttcttagcattttgctagatttcattttcaccctattatatgctggaaatgttttctgagagatctcctgtgatcatcttattttaaaatggaacagttgccttttactttttatgttgaatgacctctctttgccacagtaatgatgcagtagaaagaatgtgaaaacttgatttcactcttgactctactgtgcaccactgactgtgagaccttaggcaagttatgaaacatcatacaaagattaaatactgtccaaaacctgaaacaaagattaaatactgtacacatatataagaggatattattagtggctacccatttctccttggaatctttttttttttaatggagacagtatcttgctgtgtcacccaggctagtgtgcagtgacacaatcatagctcactgcaaccttgaattcctaagctcaagtatcctcccacctcagcctcctgagtagctgggctgctggggtgtgccaccacacctggctaatttctaatttttttgtagagatgggatctcgctatgttgtccaggctgggaaatctatttttatttgattctgcaatattgaattgtattgtttttactggcttttcttcatcctgccactctatcattggtccatcccaaaactattggcctatcccaagattcttgttccatatatttgacgaggccatccatttcaattctagattaatctttgtgaaacacaactaattatatcttagcctaaaacctccaagaaattcttctgtatgctgaaataaatatacattcctccaattaggattccatcccctctgttatatgacccctacctacatttccatttctatctcccactgttctctgttgtgtgccaacaacctgtagttctcattgcccctttgcttctgctctttcttcagtttcatctttgcccctcatcccctgcttgcccaaattatgtgtaactttacaaagctcatcttaaataccatgctctccagaataattaaaattgaatgtaatatattctctgattcacatagtccctgacacatactttttcttctgtgctctcaccctatactttgtgttaattaccatcccagatttgattatatataagcttcttgaaatcaggaagggtgtttcatgtatttttaaataagatctaagtagatgaggtataatttaatgcctaatatatagtaacaaatgtatattcattctgaatatacattttcccattgctcaggcttaaaactctgaaaaaaatcttaaatttcaaaaaattaatatttactaaattaatttttgatttttctatcaaaatcatgaattaacatatgtcattgggtcattaattttgtttgaaaataatagctatattgagtgagatataattcacatataaaaattcacccctttaaattaaatagttcagtgatttttagtgtattaacagagttatgcaagcatatccattatctaattttagaaggtttttatcacccccaatggaaacccatcagcagtcactcaatttctgcctcacctctatcctagacaacctctaatctactctctatggatctgtcccttttcctggacatttcatataagtaatacaataggtggtcttttgtagaaggcttctttcacttagcatcgtattttcagtgttcatgcatcattcactgctttttatggaagaataatattccattgaatggatatgccagattttattagttcattaatcagttgacggacatttaagttgctgagtcattgattcttttttaaactgaaaggaaaccctgtggttatttagtccagtatcctcctttaatacatgtgagattgtgtcccaaagtggtattcctagacttacatagttattgtatttcttattattttagatgctgggttggtacaacacatacattcatgtacttttctactcattctttcatatgcgtaatacatacttatggagcactaagtgtttatgatctgaataaacaaaaataattatggttcatgtcctcatgaggttcacagtttaattgggaataagcttttattaaataatcatataaataaacacaaaattagaaccatggcaagagctataaagaagacattggggaactgaccttgtcaaggaggatattttagctgtgatctatggataagcaataattacctaagtaaaaagggtagagaagagcattccaagcagagcaagagcacatgcaaaggccctggctataggagcatggcttataggagaaatgacagaggcaaggtaacaggagaggagagggtaggggaagcatgtgtggaatgaggctggaaagtaaggttaaatgatgccaaatcttccaggacaagggaagggttttactcattttctgaggagtattggaccactgaagtattttaatcctagagataatgcaagcaaaaagaaaatgtgtattgtttttacttttttttttttctcccagggcttagctgtgttaagaaaggcgaaatttgctggatgatacgttatcttttctgccaaaacttgtggtagaattgtggcatttcaagttttcttttatgtgtttaccaaataacttgttatcaaaagtaaaaacttgtattattttcacaggataaacagcctccttattagaattctccaattcaattttgtgaagaactattctttccagttctcctacggaataagcaatcatggctacttaagaagtattataataaatatataaaggccatatgtttccattatacaataaacatgttttagacctataaattctaaaggtacagaaaccattctctaaattccaattagctaatgcctaattctttagcctaagtgcttttgacttgagagccattcctctcaggcactatatgaatgggacccaggaagcttttgtagaaataatataaagcttttgtaaaaaataaaggtcatgcctgcatgggcatgaatccaaagctttcattaaattctacaaagagtctattatacacacaaaaaagttaaaaactagggtttttgagagtggaaaataatctataagttactaggaaaaaatatttggtcactttttatactacttagagaagtttaaaccaatgcagttacaaatgacgccaaatatttaaactaacagctattatataagctaatatcttgaaagcagtattctcttttttaaaaattatagaccttagatcatactcagggattatattgagcacttgtgaggaatgtagattcctggacccactacagacatttggaatcagaatccctggaatagaactcagaactctggatttttaaccaggatcccaggtgattttggtgtcaacacatgtttggaaaggtaacatagtaaataacaacattctttctctgttcagtgttttgaaaaaacaaatttatacaattcattagttataatagtaccatgtaatgcacactgaaaaaatatatatataatataatttacaatttaaagatgaagaaattatggaccaatgaaattaaataattggccacatagagatctggctttgttaatactctgtcataaagcctcttgctgtaactgctataagttacctactgctagttccgtactataagaagtactcaggaaaagaaagcttcttttagagagtggagttatatgagtccataacagtgttagtcaacatccactgaaacccatgatcatcaacaaagttaaagatttataaagaacaaagtataatacatgagcctctctcaccaagcacaactgtctgacactttctaaaagaagctctcagaggtaacactttacaggcagaaaaagtgtgaaaatgagaaaaatttgctccaagttgttacaatttaacaagcagggagtataaagaaaaaacaaaatattacagtaaagtaaccctaaaacctattagcgtgtatcactaccaaaaataaataagtggataaataaaactccatgtaactccttaaagcagctggaaaaagacaggtctgttaggttgctttaagacatgagctttaataagcattttacccaagagagatggctctgtgatatgtgtgtgctgtatcacatgaattgcgtttcatttcatgcagcgcctttattgggcattaataataaaactgctgaatttaaaaacaaattctgaaatcaactctattttatagacctttactagaaaagagctctttgccaatataatgtggtctattcataaaatatttcgagagtgaaaagatagaagttttctagttatttgtttatttctagtttctagttataattttgaaatgtttgcatttcagtaatgaagtcaggggttaaaaacattcaatttgactttaaggtggctttatcacaagaacactgatttcttctaaaatatcttcacagtttatttctttatgaaaaaatggttttaattcaaattatttaagagaaaagatcgttcctttatgtaatgctaaaaaccaactcttcaggaaattgggagccagaatttttttctgggcctgttgtagctgagtttgtcagctgccatataacagcagaaataatatttcttatgatgctgttgaaaagtgctattcagccagcagctatagcaagtaatgtattaaatgaatgagagaactattaaatacattatttcaagacttttaggtgatgctatagctgatcaatatttgagaatattttgggaaatgaatggcaaatgtcttttttggtcatgagtcaacttctctatgacatggaaacatagtattagaacaagttttacaggaaatcttatttaagagcagaaaatgctataacttcctttggatagttaaggatccttatcttttggtttagcagtggcattatgttttcttattaacacaataggaatctgtattcctggttttagtgttatttcaaagttatatcaggatctaatgaaacatggcccattcatggctgcttgctactgtaataaattcttggagactattgctaaaattaccttctattagatcaggttctcttacccccgccgtgcgcatcagttgatctccagacaatcagtgagagtattttcagagcttgaagtagacttgctgtgcatagggaaagcatattctgtttatgctaactagacagaaccacccaaaacatgaggcaaagagaaagccacaaatggcttccagtctcttaacgtgttttttatttctatttttatttatttatttatttatttatttattttaatctgttttctatagctgcatgagttttcttttagctgaatggctctctgtttggaattaacattaggaaatagaatgaatgtgaaatggcaaaaataaaatcataaacaaaagaaaacaaaactcactaaactataggatctgtagtccttcgttaagaaagtgcctccaaaatcttccttagagccaaagcccctgctaaaggtgaaatcatgcaagtcactagttgccgtggggagcacacagtgcaggttgctggctttgcagttttgggaaggccccagatggatggatcaaggagctcagtggggctagcggagaagagctctacacttggtgtcttggaattagaccactgaaagactcagagtgggacttttttattgtagtatagttattcagagccacaattttaaaagataaaacattttgaagtctgtcaactattcattggcttaacatagctctaaaaaacattctaacagtgtgaggttgaaacctacctctgaagcaaacttttgtgcctgcaaataccaaaggtagctgatgtagtcccagacgagcccagggtaacccaagcaaggagtcaacagccctcacattcctttggaacaacaataattagagcagctggaatatttgcaacctcattggctcacttgctgtgtttttaagcccaggctttaatcttatttttatgtttttgtataaatcagactcatgtggcttaattatagacattaagtggctactaggagctttagatgaaagcttttcaataccgtgcaatgcccgggttctctggtgtcctccccactctgcagtttctgtctctttgtgcccctcctcctgtgttgatttctgcactcctccttcctccattccgactgcccctcatctcagtggtgcctgtttacttaaatctaagccaattaaatacaacataataatagaacatctttctgaaaagagcacaaaggatggggaattgcatggccactgactgaataacagaagaacgaggaaaacatcttaaaagaaacccccaatagatgattcatctattcttcctttgcctcctatttatagggaggcagcctcttctttgtttttgtttccagcaatctctatgccaagtcccccatctttctttggtagaatcttaatgatatatcatcatgtatatttccaagattattgatttgagaattatcatattatgcactcaggaatatggttatagaatttccagaacacttgggagtgataacattatagatcgagatatatttcaaggcttgcttttatgttgatatattttctgagccagtaagtaatattctcactcaattaagagaaactcactttttaaaatgcgttattacaagcaatcgctttagtaataaaatgttggctgccactgttaagaaaataatttggggaggaagaaaagatatttcacattagtatcacagaagggggaggggagggtgccagcttagtccccactgtgctaattaagtgatcatgcattgcctcttgaacaacatgcagcagaagataaagaactcaaatcagctggagatcacccttaattgtaaactcttccgcaagactccagtgagtcgatgaacttcctctgcttctagagcttttagcttttcatgctaaaagtagatttgtcagaatttcatttttctgctcagatgactgtagcacagcctgtatttccctctctctggtgtggtcccctttcctaaatgcatgcctttccaaattatccacgatcaggaatgtcagagggtgtggagctcaggcaaaaaacatcatcagtcagctgaattccagtttctatagaccacagctggaatctgaatgctcacgttgacctcaaaaatagcctggtgctctgtcccctgtgttcagccgaatgcctcttcagtgaaatctctgtatgtggctgcaggttgacagatggctcccagcaggtgaactcaaggctattagtgagtgaaatgcgttctttctctgccacaatccttctcaaagacaacctcatgtcttaagaaccttacaaaaggcttttagatgttaagcaaaactcaagagaagagttgaagccaagaaaccacagattaaaataaccatagggtttctgctcaagttaatacctagtttcttcatgagataatacagtagtgctaagtggtaaaagaaaatatcatttaaagactgatattgacactttgcaattttccacaattgtcaaagcatttttccaaacatataactttatgtaatccttacaatgactctataggggaagtctcattaatagtcttcattttgagagtggcaggaggcagccaaatgcctaggcagatacaggcaggtccccggtgaaacgccacctccaagccgaagacagtaaaaagcctgaaagccaagctacatgttaaatcctctgactggattgagaacttgtgttcctgtttagtgcgctttcctctgatttgtgcctacccttcacctattttacatatacctactctttcctaattgatttttctatgctatcatgccctcctttgagtggtatcttcactttaagcttttctgcatactcacaaaccaatcagcacacactccccattctgagttcataaaaggcccagacccagccacacaggcagaactttcccaccttcgggtgagggcaccatttctcccctatcccacatcccctgtccactgaaagctattttcattgctcaataaaattcttctccctctccacgcttcaatgtcctgctgtgtatcctcattcttcttgggcatggtacaagagctcgggaaccaccaaacagaggtaccagctataacacagctataaccagcttgtggccttggcacacacaagcatggcctagtgaggcccaggtggggcatcactggcccggggtccccagcttgcaaagtgatcaagaagaaaaatcctacatcaattttattgctaacagtgatgatccaaaaagttagaaggcttaaccaatattacacagccagtaagtgttcaagttcagcttctatatctaaagtttgagttctttttacttcaaagaccaaatttgattaattcctagtcagaatggttaggaaaataaactacgtcattcattaactcattcattagacctttactaacccacttacaaatcagggaagcattaagcagggtatagcaagatttcattgcttataacagaggagctcatctacacaaagttaaccagtactgagcacacctttccattttttgcaatacgtctctcagctgttcattcattggttgaatagttactgaacaagtatttgctaccaaacaaggggtgtagtgtaataagaaaacagtcagtctttctagagtatacacattagttggggtggagtggggcagacattaaacaaatacacaatatgcattgttagtgatagtgtctgaaaatagacagtgggatgagtatgtattagtctgcccagcctgccataaagaacaccacaggctggggggcttaggttcagtgaagcataggcagccatgtagaaatatggttggacaaaaaggatattatctcataattatagactaggcggggggacccagcaagacctgtctgttcagattcttcatggcctctgtgcaacattccttccttccattaaacaaggtagatcaaagcatttctttatggcaaattcttacacagaaaggcgggatgggggatacagtgtggggagtcataatgatatttttaggttttatggctgactttgggaaaagagggctctggtttctatgacccaccttaaggaacagggattctagtttctatgacttgtgttggagaagaatgaggcctagagatagacaaaaggacaggagaagatcagaaagaaactgcttcctaggccttcattttgggttattgttttctgagccccaacattagccaatgagcagagtgagggggttatgggtgaaaaattaccaagaggcatcaagtgtaggttgattcttgccaaacctacctaatcagattcttgctgaaggcagaccaaagacacacatcaaagctggaggataagaaactcaatcagatacccagcgtgatcaaatgtcaagggtgggggattctctctaaactgattttagattcttgctccaagaatccaaaggagccaaagtcaagtcttctagttaagaagagagctcagagaagcctggctaaagtttggtcaaggagagactctttgcttctttgtgctcatggaaagaaaaggagatctggtgtctcctcctcttcttataaggactcagtcctgttggattagagccctatctttatgacctcatctaaccttaatcacctccctaaaggccttatctccaaatgtaatcacgttagcagtaaggacttcaatatatgaatgttgggggtgggggaggatataatacagtccacaaagggtataaattaataactcttcagagacactttggcagcattgtttgaaatctattgtgtacgtatatggtttaacatttttttatcctgcatatgtttttattttaaattcaaaatgctatcaaaaagtagtttacatatttaataaatactaatggcttttagaattgaaataaagaaaaaaaaaggtcagggacatgaatttcttacaatttcatgaagccttaattaactatatattgtagtttacatgaatatcaaataaatataagaaacgagaaccatacatcagtgaaagaaacattcctggagtggttggggaatcgaagagttcatggagaacacttcagttaaataaggagttgaaaaatcaagaggaaggaagagacaaaaggagcagaggagacaggcagaaagaaagagaaagaagaggaccttgcaggagaggagaaaaatacaaagatggaattaataggtctgcaaaagaactagtctaagaaaatgtgagggtttgtaacagtagaaagttcaggatgaatacattgtagtcacaatacaaaagtccttgaggctaagctgagaaatttatattttgtcattttgaaaaaataattttgaccatgagtgctactaataaatcactatgtggtatcccggcaagataagtcttacgacaacatgtgaacctgctcaatttcctttgagcctctctccaatttttttctcctaccacatgaacctgggtacctgcattaatttattctaccattttttaaagattggtgttctgtttgaatggctgttatcaaaaagacaatatataagtgttggagagaatgtggagaaaaggagacacttgcccactgttgatggaaatataaattagtacagccattatggagaacagtttggtggttcttcaaaaaattaaaaatagaactaccatatgatccagcaatcccactactggatatatatccaaagaaactgaaaccaaatgtcaaagagatatctacactcctatgatgattgcaacattattcacaatagccaagatatggaatcaacctgtgtccatcaactgatgaatggatcaataaaatatgggatatatacataatgaaatatcattcagccataacaaagaaaaaaatttgcaactacttggataaacctggaggacattatgttacatgaaataagacagactcagaaagacatattcctcatggtcttacttgtatgtgaaatctttaaatgttgatctcatagaagtagagagtagaatggtggttatcaggagctgtggcagtgatgttgggggtatgctggggagatgttgctcaaagataacgaagtttctgtttggtaggggaagtaaattcaagagatctattatacaatatggtgactgtagttaataacaatatattgtattcctgaaaaatgttaacagaatagattgtaaatgttctcaccacaaaaaatgacaactatgtgaagtaatacatatgatatcaagcttgatttagccattctacaatgtatacatatttcaaaacatcatattatacatgataaatatatataattttatctgctaattgaataaataataaaagtttggtgttttgtatgcaacttagagacaaatgaacagatggctttctgtcaagtagtgttacatttcttcagctatattctgatgctgagcagaaaacagcagtgtagtatataaataagcaaaaatactgatacatgtgccccattgctgctcaacgttccctatattacagtgccaattcatattttatttataaaataaaatatttgtttatatgtatatatatttaatcagagtcagcataagctaccaatttagcaaagtgagttttaagctgatatcaccaggcattgttatttattttcaacctttgtcaacaaggaagaatcctaacatagctacaggacccagcccatcatacccattcatccttgagatggagatatttattgctcaccagatatcagatatccatttatcccccatgtttctccaccccttgcatttaagcaacatgttcagtacagtgggctgtaagaggaagtgatgtgtgtcacttcctcattaaggcatttaagagcctgtgctcagccctccagatgtcttcttttgctgctgctgtaatcctgaaggctgtgagttgagccacaagaaggatgtacctagagagctctgtcactgcatgagagagaagtggcctggagagtcttcctactcacatcaggatttgtgtaaacaggttataacctttattgtgtaaagcctctgagacttaagccttacttttctgactaatctaattgtttatccttcacctacttgtatactatttttactgccttgaattatgttgagatgcttcagacaagactagatcatttctactaaatcagcttaacccagcccgttagtcctctacaatagcctggagcttctgggtttagagatgaaaggagataattcttactgtctaccttacccaagttctctgctccactgaagaccatatgttatttgcataggaatttgctaacagctcttaatcctttcaaattatattttgaaataagtttcctttgcaagaaacataagtttctcttaaaaggaactttgacaaaagctccaagaaagaaagatcattctctgatattttcaattatcagtgcctttgggacaccatgacttccttctactcacaaatatgtagataactaattctataataagcacattagggagtagaactggtttagtagcatgttagactaaatgattttatgttggcatctgctttcctatttaaaagactgcttgaataatagatattttcccaactgttttggacattcagtcttcaatagctaaaatattgttatcctggacaagtgcactaaattacatgaattgctcaaaatcttggtaggtcagattgatagtggaggtggagtacaatgttattgttgtttatttgagaattgactgaatagcttaatgctagtcattgaggttaagcttagcctttagaaacactattcggaggccaggcttggtggcttacacctgtaatcctagcatcttaggaggccgaagtagatggatcacctgaggtcaggagttcaagacctgcctgaccaacatggtgaaactctgtctctactagaaatacaaaacttagctgggcgtggtggcacatacctgtaatcccagctactctggggactgaggcataagaatcacttgaaccctggaggcggaggttgcagtgagccgagatcacgccattgcactctagcctggcagcctgggcaacaagggtgaaaccaaagaaagacagaaagacagaaagaaagaatacaggattccagcaacttcaggcatcttgatttttttttttttttttttgagagagagtcttgctgtgtcacccaggctggagtacaatggcacgatctcggctcactgcaacctccatctcccgggttcaagtgattctgtttcctcagcttcctgagtagctgggattacaggcatgcaccaccatgcccagctaatttttgtatttttaatagagagggggttttgccatgttggccagactggtcttgaacttctgacctcaggtgatccaccctcctcagcctcccaaagtgctaggattacaggcatgagccaccacgcccgactgatgttttgcttatctggcaaagtctatcaaacatgagatttaaaaactaaatgatacttacaatgtgtttcgaaggaaactaaagagtatatcctggctcaacaatccagggaagattttatcttgatgactttgttgtttaataaaacctgagttcttacagccgttgaggaaaccacaacatggcaacattttctccaggagactctgaaaatctgcatgaatttatcattatagcctcaatgctgtaggtagcaaataacttggacataaatatgagaacagccaaacatatatgcagcctaagcacattgcatgcatatcttattttacggagtaaccagctaataaaagctgacttcgtttatagctgaacaagtattttgggttcctcattaaatgatttactcagcttactttgtgatgccagtgtgcagtgtacatcctattctctgccttgtgtaggctaactcttaaatataattgttaagcagttgactttgtcatgtgttgtaagtcatgattctcaacagtgttcatatctggctctaaaaggttctggaaggtagcataagcacacctggtagaaataatggaatgatataatgggaggcagaactgtggctgagtatactacaatttgttcaagaagctgaatgtgctgagtaaaaaaagtactttgtaggtaattctagtaaattaaaagttgccatcagtgtaatatcattcctcagagaagccacaagcccttaggctcaaaattgtctctagccagagttgaagacctaaaaccaattctcagtgtctgtggagttggtatgtagctaaaagatttgggcactttctagccttgtgatgctgggaaggacacttaaactctcttggcctgttttctcatttgtaaagtggggacaataatagaggatgatggtgaggaataaattacttaatatatatgaagtgcttggatcattgtctagcacacaataaattatgtataaatgtttgctaatattattttaggcatgttgcagccactttatataatgaatctaatgttaaaactatgttgttaatgttgtaaaaaaattagtgttaaagtaatttaatgctatttatatgggtacaaaggatcacttctaactatcctatgttaatttaaaatttcgtatgccttgtggaataggccataagttgctctttaaaaataaatccctgagagtatgtatctctttctcataaagtctagaaaattatagttatttctattttttataataaacaaaacctcataaaagtcaagcttatgtgaaaatgggccattctttttatgactgataggtattgggtaccctgaattttttaataatcgtctcatcctttggccaataatttcccaattcttttgggatgaaataagcttttaagtatttagggttggaatttcactttcattcatatgtaactactgagttaatttttggaaagactaaaagacaggattttttttagtgttgtttttaatattacccaaataatgaacatgctctttgataacagataggttaaatgttttctgtaaatggccagatagtaaatgttttgagctttgcaggccatatagtctgtcagaatcattcaagtctggcattatggcatgaaagcagccatatacaacgtggaagtgcgtgggagtggctatgtgccaaaagcactgtattttttaaaaaaggcagcagcaggatggttctgacccatggaccatagtttactgattcatattttataaaattcattttttttcttatttttactagggtaaaagacatacacatagaatgtgtactcacacacttatccatatgcatatgtgcttacttaaaaatcatgaagatgaagcacaaaaaacaagcactttaagaaatttaagaaaaatacataatttcaagagaaaataaaacagatattctatccagcattcatttgttaagtacacaaagactctttctatccaaataagctccagagctggcctaccattctactttagttctaaaaccaacttagaaggtttaatttgctaataatcaaaattgtccttaaaaattctctaaatagtctgaagttattgtgcatagaactctgtattatactgttatatatattccaaatgtgagaaccactgagctggactaaagaaaaaaaaagctatatgcaaagatttggacggtcagacctttctttttaaaatagttatcaaattattacagggaatggagaattctaccatgtttcttcttgcctgcagacatttttaaatgtttatttaaatgttaagacattctaactttaatatgtactaataggacttgtttgctgctgcacattgtgtgtaaatattcacagattaaatgagctaacacatgtaaaagcacttcatacacagctctggcccagaccatattttttgcttttgaatcaaacttatgtctgctcatatccatatacacattggtccttagaggttcatacagaagaattgagccatctgcatcttgtctttccaacttgcatttcctagtgggtcttaaagaagagttaataggtgtcagagtttgagtctgggttccttacctgtagagcaacatcttcctagaagatatgacggggtccactctaccaggagtaaaatcacacaggtcctgacaaaacgcatggagatacatagatttagatacctagtataagagagctggactataaaatggccctcagctctgcaatcccttatgtattgtgcgtcctttgtagtcctctatagatgaagatagttacacctgaatggcttatgaagtagaaaacaagcctcgtgctttctagtaattctgtttatttctacataccacttcagtaagaagtattctgtattgttctaggtggagttcctaagcagaactgctaatccagaatgacatttaggattctgaatgtcaaaataagtttagtactccatggagaaaatttaatgagttgttaaaaaattcctctccatcctgtgctggagagaatcaatgcagactgggctggaggcccagtcctttaaagattactggatataattaatgatttactagaatgaatgtattctcttgggagaaaatatgattgtctgctatttattagctgaagacaatttaaaaatttattctcccttggatgtaatacctataaagtgccattggagtggttttcaaagtgagaaaaagcatgcagcagttagcattttcacttttctattctatctgtgatagttcccagccagtgataaatgctcagtgtatgaccactataaagaaccatgatgatatccatctcatagtcttatagttgccagaagagaaagccacaagatgaattctgttgttgagctacttgatgtgattaatgtatatggatcagggattaaactattaattttctatttttttaacagaaagaagccagaaaatattatcaaccctttgagaacacgacacaacgaactttatattttaccacttccttgaataggtaagactctctctactctgaaagagttacctacaagtgtgaaaaataactctttgctaaccttttgttttttaaaatctttaaataagtaacaattcattttagtaatggagaaataacttataaatagttatttctaatattttaatagttatagctaataaattcagtgttattaaaacagcacttcatagtgttgagttgacttaatagtaagaaaatgacaagctctttctcttaaatcaggattgaattcagcctgtctctcctgccttggttgacaatgccaacggtatttcttcagtacctgttacatgccaagcatgatcctacatgacttaatttgcataaatcaattcatttacttcttacaacagttctatgacgtagatatggggatcatccccattttagagattaggggcatgaggcagagagagaagcaggtggatgcagggattcacctgagattgcatacatggctttggaagcaggcactggacagaacaccagccccagctgttattaggagagtagtttcatgttgtggtagaaatgtctagcaatcagactttcctacattttgagtagtttttatcaaaatttatggaataaaaataacagtgcatttactgaacgcgctataaatgcatagcagataaacttttatgtttgcatttgttcctcacaaaatttttgcatgagtaaataaaggaatatatatgctttagctcagttacaagcagaaataatattttcctttattttacatctttctttaaactcaaaattcctatgataaaagcataataaaattatggaaagattataaatgaatgatttcttattctaggaaatatatttcaatttagtttttttaaattagaagtactgaatatataatcttaaattggccacagcagtattcactttcttgtttttattatttgtttttaagcaagaaaatttataagatgttcaaagcaaaatataaaaaaatattataggccgggtgtggtggctcacacctgtaatcccagcactttgaggccaaggtgggcagatcatgaggtcaggagtttgagatcagcctggccaacatagtgaaaccccatctctaccaaaaatacaaaaaattagccaggtatggtggtgggcacctgtaatcccagctactggggaggctgaggcaggagtatctcttgaacctgggaggtggaggttgcagtggctgagatcacaacattgcactccagcccaggtgacagtgcaagactctgtctcaaaaaagtatatatattacagcaaatacctaagcatccaccacacagattaaacaaatgctaacatgcagctatattaaaatcttgtctaaaaaaataatcacagaagtcatcaaagctcttcttgcttcctttttagtttcttccattcttccagagatgtcaaaaccctaaagatcatataaccttcctgtgtgtgttctaacactgctatgacatgtgtaagaaacaaatgttgaacaattattaacattttaaaagtttacatgaagggcatcacactgtagatattcttttgcatctcatctttacccaatattatatgtagagattctttcatatcgaggcatgaagatctggttgacaccttctgttataaagttgactcatcttaatgttttaatcttctggtgcctagtattattaattattatttctaaataactttcagcattttaaaggtttaatgttaaaatggtttaagcatggcttgcaaaacttatttgagatttatgtataaggaattcaaagtttttaatatataatatcatgccaatcctgcttatgttttatttttttcaactagaaaaacatttttttatttggtttgtaaggatcttactaatctaatgggactcatgattttcattcttttgctataacacaataattagaatctgttttatttccctatacatgaaacacttactattcccaaatatagtataaattactacctttggaatttaagatacttaaaagtgaaatatcttggtctggcctatgttagttgctcatattctagaaaataatggaggaaactaaaaaagaaattttttttcaaaatgttttctaacactatagctaattttagaatttgtttaaggtaaaagaaatgttagtatatggtagtgaaatagtagacatagactctctcccaacttttattttctgagagaagtaaattatttcgtcaaagttgggggaggaagaggaatagaagactaacctttttgggcaaatttgagtaagtaaatttgagattttatataagtctcttaggtcagaaatgcattaccattttgcataggaggcaaataaggcccaaatacctcaggtaacttactcaagatcatataatgattgcagagcctgcattcaaactcatccctttcaggctctgaagctattctgcctaccagaaaataaattggaaaaacctaatctgtttgtcacatatatagaaattttattcatgccactaatatttattgggatccttttatgtgagttgaggtccagtgttaggaaagcaaggaagacacagtacctaaaatgagaaacagtctattgaaaaccacgaagattaatttagtgataccactaaatgtgactatttaattagacatttttattttgctgtgatatcctcacactgcttaccaggtgattacctttgaaattgcctagccatgccaattcaattaaactggataggataataggagtgaaaatgttttgcaaatgacaaaatctttgcaatcatttgctaatattactaattctcatattccatgaatttagagttgaatacttctatcctaacacatgtacttctaaatgtgtttgaagtttgagtcttactaacttatgtagaattcacatatttttcggccgggcacggtgactcacgcctgtaatcccagcactttgggaggccgaggcagacagatcacaaggtcaggagtttgagaccagcctgaccaacatggtgaaacccccgtctctactaaaaataaaaaattagccgggcatggtggcacgtgcctgtaatcccagctactcaggaggctgaagaaggagaatcgcttgaacccgggagacggaggttgcagtgagccgagatatttttcacacaaaaaccttaaatattacagtgcagtggttagcaactctgaaagtttgtttgtttctaacaaccaccacctgttaaaggcatgatttaatctctttaagactcagagtagataattacagtaccaagctcatgcctgtccaggatcttatcatgccttatcatctctacctatatcattcacatccactgtctctcatgtttactactatcataatcccctgtactcagtcttgttcttctacagtctattgttcacatggaagtcagaattatcttttaaaaacatcttaatcaattgatatgactctcctatgcagaatccaccaatgactgcctgtaatagtcaaaaataaagcccacactcctacaatggccaacaagatgctacatatactggcatcttctacctacatcatctcgacatgatctcctctcatggagggcagagactatgatgttcagagctgtattaccagcccctagaactaccacctatcctggtggatggaccctcacttgctgaagggatgactaggtatgcaagggttaccatggaacaatgtaggtagatgctctgcacacagagtacctttaatgcagaacagtgatagtcgttgcccttttaaggattcctttggtttgtttcaacagaggccatcacatctgcaatgctaaagcactttcatgtttttgactcatgattttatagcattatgagaaactttacttagctgatttataattgcaagccataatgtataataccaaaagaaagaaaaatgcacatagacaaatcaggaactaattagctggatgagaaagccagttgaagagcagaaaatatttattattccttgcagtcttttaactaaataataatactaagatttaccacattcaacatagtttagattttactttatcttcagaatagatttatatctcttcatcactcatagatgagcaaagtttatcctttaagataattttctgtaaaataggctgggtttttgttgttgttgttgttttatttttataatattcctaggagaagcacttgatgagtgtttatatcattgagaacatttggcaagagaaagacaaacagtagaaccacaataccccaacatttaaggaaatgagaaagaaaacctggtattttcaccatcctctctgaaaataaatactttgacttgcactgattactacttcatcagcattcaactccgctccgtggcactctgtgtgaataattttaaaggcagattaagcattctaaaaataaattctattggtaaattaggatatcagatgcttccattataaaagcctatcctattctgtactctcagctggcagtcatatccagatctcaagctactctggctcttattgaacaagaacctattccaggagtgaggttttgaagagggatctctcatggttaactagagacagaaagaggcagaattgcccacatactctggcaggagttaaaataacaataacagccctcctacttaacaggctgagtcatcagcacattctactgatttctcagtaattctgggcagattgtttgggctggaattctgtaggcagaggtgggcaccacctgcttcaaaaggctctagttcttattaggagggtgctgttattaagtcttgtcttttaactgtttgaccaaatggagataggaaaagaaaacaaaaacggtgctgatgagcactttttctaatgcttagaatttttaaaaatggtggtccaggcatggttactatgcaattagttcttttactggctataagtcactttgcttaagcagaatagggaagattattttatggttgctgagggacctcataatccaagggctcagaaacagatcttatgagggtctagaatcaggaactaaacatcagccaggaactaaggccaccattctcccaatctctctggggctcctcagcccgatccctctgtagctctctttaattcaagatgactatagataactctttacgtagagactggatttccctactgcccattacacaagcacaactctcaagtgtgctttctcatgaatgccagcttcaagcagtatattaatttttaatgacctgagctgcttagctaataagctgtgatcaatggaatagaccaggtggtgcatatatagttgccaggatcctatacctatgggtgggaagagggaagaataatcagtgaaatggagtctcaaaagctattaaaaatctcatggtacagtttatttataccctaagtcttcccttccacaaaattcccctttattgaattttattgttgtataaagagccaaagagtaggatgttaagagattagaagagcagggagtatagccagcctccaagggaaagacaaatggataaaggacttcttgactgtggtttttgtgtaattgatactttagggagtgttcactacatactattttttccttcttcttcacatacttaggtatattttatggttgtcaactcatgaaaaccctattactgatcaagggtcttccatattggttggtgctcagaaactgaggatgtttataagcccttaaaagtcttattcaagctctccttgtcccttgagctagaaagtagcatttttcaagattgaagggagctacaagcaaaaaaaaaaaaaaaaaaaaaaaaaaaaaagagagagagagagcgagaatagatggaaagcaaaatgactgtcatagacaaatctagagacagaacaagcagcttaaggaagcatttcaggtgcaaagttagcattcagcctttagcttgccacattttcctgtaaaaataaaactgcttataagatgcattcatctgtctgtcctgtccctttgatgcaatatgaaaaatgtgaacttagcaagagatgtgcgggtatgtgggtgtctgtgtgtttacatgcacaacttaaaccaacgtttcagtacacatagttccaaagaccactcttctacaaaacttggcatgaatgtgattatgagtttgggatgctttaaaacctcagtcctatggtcattgaaacgaattttaatttgaggatacagtgtgatatgaggaactttgcaggcagacccttcagctactgtcctgtggacctggctgttcctgaggaggtgaatggccattttcccacaagtggtatgtttggccggttccccttttgtccctcaggcttctgttgttggcaaaaaaaaaaaaagtagttaacaaggaaacatttttcttaatggtcataatctaactgcagcataatacctgcctaattctcactgaaatatgaaaccaaatatataaacttattttcgagccaatcatcattttacaggagagaaaagagtatgtgatgaagcaaagatctttctatttactcattaaaaaatattttaatcctaccttgttcaagtctctgttctataaagcatgagaaatccaagtaagggattgtgtagaagcatgaaactgcaacatgtgttaaaagaaacagcaagtccattttaattggattatgtaaggtagtagactgagttgagtcaaaaggggtaaattgaaataggactgtggagatgctataaaacctaacctaggggcatgcactttattcattagatagtggggattccgtgggcaacacggtttctggcagagcaatgatgtgatcaaacttgagttaggaagtttgattacactggcaaagatatgtagaatgaattagacagtagattctgaagcaaaagaaaattggaggtttgcatcactaatatgtatttacaccttcaatatgtggcagtggacaagaaagtgagtggaaaagaaacctgtagctgaggataacagtcaggactggaattatggactaggtactcatctacatatccagtatctgaactatttggagtgaagggccatggagaagagaataatgccagaaaagagcaaagaacattagggaacattcacattggtggggagaagtggagaaacagagaaaaatgagaaggatatttagaagaaggaatcatgcctatcatgaaccaaggttgttattacagaaaatgacatttaagtcaagaagaaagaacgaacaacaaaaaagtgtcatacttcgtgcttaatagattctcagtgactattaagagacaggaaaacaacagtaactacaaagtctctatcttcaactccagtcctgagaccaccaaacacaaagtttctaccatgctctggccatgcccatccagatatgctgtcgtcagtcatcacaaacacacatgtccctctgtgctcttcctggcacccaaagttttaatgtatctccgttgctatccatcaagatatccaagtagaaatccaagaatctattgtttaatcctcttgctttaattcctaaatctggccaggcaccagattctgaagtatctcagaaatctgagccatcctcttcctcactcttactctctcagcccagggcgtctaccagaacctttcagtggcctttgattagtttccctcttcctgaaattctttataaactgactctcctccatgctgtcactgtgtaattttcagtgtatatcagatcatttctttttcctacttcaaattttcctacagtctaaagctccaaacatattaaatgccatttagaacacgtcaaagcagctgtttctggacaatctccagtctttcctttctactcgattgccttttcttcattctaacctcagcaggtgacttgtacttcctcaatttaattatttatttttgtatgccacgtttctctcatgttacaatcacctttgttatttccgttactcctgtctaaatacccgtgttccccttgtctgccttccaaaagcctatgtctgttcaattcaaatgccattccttctatgaagctttttctccagtcctaaaaaagtggtattaattgtgcctttaggcaataaggggcatctggtagccttttaaatgtatctgcactatagaaaaatcatcttggcgtgtcattattcccatccagttggtgaagtctcaaaggcaaaagtttcaccgcttccaaaaccatgttattcgattttaaacaaaacaatacttaataaattgttgttaatagttgttactaagttatgagtaaaataatgagtacgtgataagtaaatggattaaagaggtgaaaagaaataaactgtagccttgagatagatttacaaaatagattttatggtgatggttactgtttgtcatcctttcgtgtggtagggaagggggtttgttttgggtaggaaaaaagactaggtttgtagtcagaaagcaagaaaaggaggaagaatgagctggaattgtgagaccatgaagggatatatgacaaaattttggaggaggcaggaaaagatacgttaaagagcaaataaattaacaaaataagggccacccattcctctaaagaaaggtgacgacaatgagggcaaatgaagagggcctagagagacaagacatagaccctttgcagggcttctgttttttaccatctcaggaaaaggagggctttcactctgcttttggcaaacatcaagctgtcctaagattccctgaatgtgtttgcacattctgtctgcacattggccagaaagcagatgttacaaaaggaccaacccagaagctgggccatctttgctccagccacaccggagaagggcatgaagagagaaattcaggaagagctgcaggaaattctttcctcaagtttgctctctcacttctcccactccacctcccacagggtgttctagttgctgtcaagatttgctgtgcaggcaataaactggggacagtgacttaaatgtttcatttaatcctgctacttctattagtctcatcgattttttggaaaatctcattatacttttcttcaaaccaaaaggattagcttattgctataacaaacagatctagaaatgtgttataactttgtttcttgctcacctaacagtccaggttcagtgttccagttgaaacgttgtttgtcctcttcgtagtcagccagggtccagacttcttccatgtgtggctttgctttgtcattttcttcatccagcgagtggaagggaaaagaccaaggaggagcaaaaggcagctgtacctgaggtgatcttggaagtgtacacagcacttctttctgttcacctgccattggtttgaactcagtcatttggacacacctaatcgcaagggaagttaagaaatgtactctagctatatgctcaaaatcaaaaaagattttggtaaatggttagcagtctctgttataccaagggaaaatctgcctacaaattaatatatttgaatactcagatcaagtagctcaagctgtggcaaaaatagatgtcagttataccacagagataagagtgtggattgtaacttcaatatcatgttaaaatagtaaatgtattaaatacactagtttatcgaacttaattcttataataatagagaaagcaagcattttgcttgggcaacatagcgagacctcatgtcatctcacaaaaaataaaaataaaaattagctaggaaggttgcacctgcctgtagtcccggctacttgggaggctgagatgggaggattgcttgagcccaggagttggaagaagcttgagagagctatgatcatgccactacactccagcctgggtgacacagcaagagctctgactctaaaagaaaaagaaaataataaatcagatattttacataactctccttatagaaatactcattgtttccaaaatgataatgacttcaaaagcatagtgtctattgccattcttggtttcttcagtaacttcttattaaaggaatcaattgattaattaatgtagaaaacctcattatggaaaaaataaatatttgtactttaatgagtttctaaaatttattataaaaagacaaattggcatagccagttaaaaactcatttttgtactgaagaaggatatatggccttttaaggaaaaatgaagagtaaaattataatagaaaaaaaccctgagttgatgcttttgcaaaaatgtttaaaaaactgtgatgttttgatgaacttacaaataaccgtatatagtcctgacgtgatattttgtatttgctccatccatactgtttatttggatgtttataaacattactatttacgtggagggtagcagtgcacctggtttatatgaaaggaatatagtgtgttgcagtgttgcatgaaagctgttctgttggataaatattctacaaaatcaatttatctgctaaaaaaattctataattgggtttctgtttcctgtgactgcagaatgcttgggtgtttgcaaaaatactgcattgcagtaagtgtgtgatcactgttttctccctgaaagttaaaacgcattttctctttgagagtaggcggccatttaatagaattctcatgacatcagagagcatttcaaagggaagaaaactggcctttcctacaagcatgtaagcaaagacagtttgatgttttcttctatgtgagattaagtagccagcaagaccccaatgtggctgaactcaggggctgattccttctgagtatctctgtcaaatcattcttcctaagaagtgtgatgattttacctaaacctagtaatttcttgagatttttactcttttcttttatcacccaccctctgcacttttctaatgaatatcaaggactccagttgtaccatgtgctcagtaattactacagaaggcagtttgattctgagacagttgtagtctctgtcagagaaatttagaattcactaaagcaaatacttcagtgagggagtgccaaagcttgagtcatttacaaccattgtgaacagagctctaggaaagatccagtagtaatcaatcctgaataaaaagcaaagggccaacacaatcaaaaaagacctttctctaacacagacagactgctgtggcactagaaagttcttcctactggcctactgggaagcagtgtgtaagcctttttgttttgagcctgtgtgttcctttttggcatgtgtttacaattggagtgagtcctgtttttggagtgtgagaattcaagagagaactttattttaaaagcaagggggattgaaaattatagtacaatataatgttatatacgtatatattatatatatatatatacacacacacacacttataagcaacagaattgaaaatataacagcgtaatacattgcatatgcacactgatatataatatccatatacatacatctatggattatttaaatatacactgtaagatttgactgaaacatgaggacagggaaattcttcattgaaatactatagggaagtaacataccaatgtatatttttaatgtaattttctcatggcagagctgagtaactgtattacatagttcaaaatatttgtacatggaaatcacacagaaaaacattctaactttattttctccacaatagtttaagtaatgacaagcctatcctgcaattattctttctggcatccaggatctaccatgcttaagagcctacaaagacttcccagcttgtataggatcctgtagagcttcgtcaggtgaatttttgaaattatacattaaaagtctaaaaatcacagaatgccaaatgaaagctcagaacctacctgaatagtattctctacaagcgagtgtactgctgctgtattctgcttttctcagctcatctggaatcccagaaagaaaaggagcagttctggccgggtgtggtggctcttacctgtaatcccatcactttgggaggccaaggtgggcagatcacttgaggtcaggaattcaagaccaccctagccaatatggtgaaaccctatctctattaaaaatacaaaaattagctgggcgtggtggcaggcacctgtaataccagctacttgggaggctgaggaacaagaatcgtttgaacccaggagtcagaggttgcagtgagccaggttcacatcactgcactccagcctgggcaatagactgagactgtgtcttgatgagataagacaagataaggtgagaggagataaggtaaaataaaataaggtaagatgagataagataggatgagatgagataagataagatgaggtgacataagataagataggaaaagaaaagaaaaatgggagcgatcagtccacagtggcccttttaaggatgctgttaccagtaatacttctaacctaaccatcagcctcactggtccctttttctcctcacttactacagtgattaaaatataaaattgctatcctttgttattgtgatggttatgatgaaatgttaaacatatgttaggtttaatagaagattaatttttgaataccagtgcattaaaaaattaatgtctccttaaactttttgtgatttttctaaaatttgttttattttaatattaacttaatcttttttgtgttcttaataatttttttaaattcactcttggctaggtcctatttacctaacttgcatatgatgggtctatttttatatctaagtattttgcctacaggcccaccacataatattgccacatctattaagacttttccaaataagattggaatatttgtctttgcagaaaaattaattattgtggcaatttaagtacttgaatattttttctagctcaattttttaacgtctcataaatgtaaatgaattgtatacatttcaggcctggaggatttagcaaatgtatgtcccatcatacccctccagaagtttgacagaatacaagtagcatgccatggaaatcaacctgattcctagaattcactctggggcacactaagataaatctactcaaagagagaagtcaaacagtatatgaaggctgatccagttggatcaaacttgggttgcaagggaatttcagatgacaaggattctctgtatgcttccttttggcccaactcaactgatatcatgaataaggctactttcaacttagaattcctctgaatcacaattacagctgcagtgggcacagcacaacacaagcagcctgccccaaatccacccctagaaaaaaagaaagaagagaaatgactctgctttatatgactcatacgttacttatatatgactaatatttacctttccctggagaaaaactagtatttaacataattaactagatcgttgatgctccacagatgtagtaggttagtatactttaaaatgcatgtaatacaaatgttttgcatccatccatttttctttttaaatatgtatgactcagaaggtttttactcatgtagtacctattttatcctctattattgcatttactgtgttataatgtatgttttttcaaacacatctgcctttctgaatacagtgtaagcagtttatggtcagagtctatatcttaatcatcatcattttcctaatgcctaacagcattcctgatataaacctggtattcaatcaatgatcattgaataagatactagaaaccaacataaattaatcgatggattgataatgatcttaaaattaaatgaaggcctgatacatgctcattagagatcattatcaatccattaacttatttattttgctttctagtatataattcagtaatcatttattgactaccacctttatatcaggcccagtgctttggtcatttaggctctctgttgcttaagcaatcctcccacctcagcctctcaaagtgctgagattacaggcatgaaccaccatgcctggcatcagcacaaattttaatgaaaaggaactcttctggacatcatatgtgactggaccacaaactgaattcaaaacataataatgtcaatacccatcaaaattgtataaaacatgatattttatcattcttttcaaaacatacatgtaaatagatgatagataaatactgtaattcatgaaacagtctgttaagtttattagactgtattaatttgaggattaggttttgttttaattaattaatttttttgaacatagaatctagccccttgtttcagtcccactcacactgccatagctcaggcccagttcctttcaaacaactgtctctgagaaatgtttctatccttagccatgtcttcttccaatttactttccataccactgctggatcaatcatcctaaaaaccaagctcgagtgtaccattttcttttctccatctttcatgggcatccatggccttcaggacagagtgcaggcatggctcaccacatccctttacaattctgccattgcctggccatcgacctcatttccacacttcccacttcacttctgttccatagtgaacaattttgtgccttacatgaggtttttttttttggttgttaatgttgttcatttatttagcgagcatttgttgtggagcctactctgtgccacacactgtacttggtgctggaggtcagagatgaattaaacacagcccttcctccaggagctcacagccttgtgagggagacatagagtagagaggaacctctgacccagagtgagggctggagttatggagatgccagaagatgctcattttggtatctttctagaaagtgttgcctagcccaagtctcaaaaacaaacaaaacaaaaacaaaaatgtaggatttggtcatctaggctctttcttcctagaaagcttcttgtcctttctttgactacctcctacttgtcctttaaaccctcttccaggcagtgttgattggcttcctagtgtggcaagagatgttgacgtacctccacaacttcccgtccttatcaccatcacagcatgtaccacactgtattattgttattggtttgtctgtcacctccttcaacatgagggctatatatttttttctagtattcccagtgtgttcctactacttgatacacagaagcctgtccattaattttttaaatacagttaaaaaataattaattgcttaatgcattaaaatttgtaatcttagagttggacaacatcttagtagtcatacattccagcctcccatcagtcaaaaccagaattgattctataatgttcataacaggatggtcattcaggttttgcttgcttgaacacgttcactgataaggaatgcaatcaggttcaaagaaatgcaaaaaaaaaaaaatactatgactatgctgtaaatctgtttacacttatatttggaatgtgattttaatttgaacacgttagagacagagctttagtcagatggcttgcatttgtggagaaacaattgttcatcagaagataaagggactgagcagatcccataaagagaagggcacacaacaaatggtatcctgcttataattctccaggactttattcttcctctgtcttaaatagccaaaaagccgatcccactcatagaaaactatcaagcatctaatttttgaatttatgttctaatacattctccagtttcaattatctattcttttttttttttttgtcttttcatgactgccatttcttctccaacttttagagttttgttttctcttaattttaattctagcatcttcttccatgatgtataatatggcctccaagtttacctggatcatggccctgttacaataccagaaaatctctaaagcatctagtcctcaagtactgattgttatttttagattgttgttaatcccagccagtggcttcttcataatgtggctctcaggtatctcaaacccaaggatcttcactctgtggtggtgcaaatacttatggcctaaattctgctttgtaatgtctgcaattctagccaatattcttcagagttgtgtccaaagaagatttacttttatggtattttgttaagtgaacctggaccaagtctgacaggtcttgaatcagattccacactggaaaaagtttaaaacaaaatacattatttatccaaatccaaattataattttcctcttaagctttttatcctgatatttaaatgtatgcttatgtaagaaaaatttttattaaaattatgattagaattttttctccttataaagaaaaattctaatgtaggggtcaaagtttatttgttcaatggctccatagttagttacatacttatgaaactaacactctggtttagcatcatgtccaagtttacgtatctagtaagcggtagacccaggattcacccctatttttctgattgaaaatctgttacttattccacaatatctccagtacctaaatgcaagtccttaattccttaattaaatatcactggtaggggtggggggacttaaaaaaaagaaaaaaaaattactggtagagactaaagctctaaagcattttaaatattgtttatatctaatatacaggagctatttattagtcctctgatataataaaaaataggctcagaaatagtatacagctgtgaagcataagttgtatatcatggtcacataaagacaattgcccagtttcatatggtaggttgttaccaatcgagcaggtttacaaagttagtgttgttatctggagtggattctctttttagctctaaccctattccaccagtctcactgctttgtgaaacagcaagcaatggaacggatgttgggatttgacttctccttccagatctctctggaagtgtctaatttggttaaataattgtatctattcttggtttttcagtgtgggtcaaaccatgtactgaatcctattgctgaaaattttcaaataaaaaccataaaatgggctgggcacagtggctcatgcctgtaatcccagtgttttggaaggctgaggcagaggaattgcttgaggccaggattccaggcaacataacaagacccatctcttggtggtggatgggggggattagctggctatagtgatgtgcacttataatcttagctactcaggaggctgaggcttgcttgagcccaggtgtttgagactgcagcgagctatgattgtgtctccgcattccagcctgagtgacagtgtgagaccctgtctttgaaaaaaaaaaaaaagaaagaaaaagaagaaaacacaaaataataacaagtagtaggtaacatttcttaagcccttccaacttgtctgaacttatactttatttgtactatctatttctagcaataacctaatgttatctgtgcctatgatcatttgaaattacgtgttatgcacccaccagctctcttctttctaattgtttattagtcatggtatgtgatgaagaatgatgagtcatccttataggtattttacaatcagcctgaaataaagcagggaagatatgaaacaaatatctggattttcagcatatctttttcatgttatcaagaaccttttcctctgtttttcttagaagacaaagagggagaatatagagttgcaggcagcttattaacaaatgtttaagcttagaacttctcagcatttataagcaaaaatatggattctgcataaacttctaataccattaaggaccaaaacaaaagtttctattttgtgatactgatatgcatagtaacagtataaagcataattgagcctacatggaaaagagaaacaatatttatgtgcttaattgtattacacaactggtcattttagccttttgttcatctgtggatatgtagcagcacaaaattataaaaccaatgtttttgattgaactggcacattacatgatgatagggcagaacacatagaaaacattctagaactgtctgtgccgaacacattattaaaatggagacatgcctatctggcacatagtgtatttttcctttagattttccaagactttattgtttctccttttgccaatttttgagagtagttagtgctgcctggtaataactatcatcagtaagtattcctgtgctttgtgatctttctaatattgtaatccaaagaaaaccagtgaggtttgtgattatgtgggaatcccaggagggaaagttctattcttcttaatgatattttcagcacacatgtctcagtgatctagatactaaataattcaattacttctttgagagctttacaaattcagagttatctaccacacatttgcaccctgcttattaccccacatccacctccaaaatgatctaatggtaaagaaaattgtaactcaatttgagatattttaatcaagtgtacttctatcacaaaccattaatgaatgctaaggggtgtttaaagtaaatgttcgaaagacgatttgaaaatgccagggactgcccattgttttcataatgtgaagtagattttttttaaccatggacaattggtaattttaaacattcttggaagatactacaagtaggattaggcacaacagagcactgccttattccccataagctagaatacgagcagtctatcttgtgatttaactccatcaactcatcataaatgttctggacaaaggaagtgaaagacccaacttctatttgtgagaatagtcatgtgacctatcaacatagttgccttaacccttcacttcagttagtctatagggatgttccatgtgtgtatttttatcactcctcattcttttctgaggtcctatgcagcaagcttggctgaaagcactagtcttcaaatgtcaatgtatcagagtcaccctattgagcttgttaaaatatcaatttgcaagtcccacattgagaaattctaatttgttaaacctgtgttggagctaattgactgaaaacactgtaagacacactggaatggatgatcaccaaagatcacttcagttttatgattttaaaacattttctccaatggattgaagtagtttatcttaaaagtatttctaaacctttatatcatgtggtttctattatgattactagacctctatcaccccatttatacagatttagaaatgtttttactagaccctattcgtgtccagtagtttgttttacttggtgttatttttcatatgcaccggagcatatgaaatggagttagaacttgaattccatacttctaccatgacagccctgaaaattagattcaaaactattcccctcttaacccaatttgctatatagtgttggccaaacatccacagcaggcagaacctttctgtgtttaccctgaggtaggtaattgattaattaatattcattcaacattgaatacatatttgaaagctgggaggtggaggttgcagtgagccaagatggaaccactgcactctagcctgggcaacgacgtgggaccctgtctcaaaaaaaaaaaaaaaaaaaaagacaatgaaaatgaaagccaaagtatgaccaaaggctgttttgatagttttttatattgctatcatggtttggttatgcacaccatactttcaaataaccccttttagacttcgaagaaaaggtatggaaaacttcaaaattttaaatgagtagaaatgagaaaattgtttcttttttagtaaaatgtatttctgatttgcatccttagtcctggagttatccagagaaaataaattcaaaattcatcaatagctcagactgatggcagagttgtcagggacatttttttctgtgtgtttctgcttacttcttatttctttcctttaaatagtctgggaaatatgacagctgtactttattttcttgtgtctgcaagccctcagggcatatgtgctcaggaactactttttgttacacttaaataagtatgtctatttgccacttgctctaaaaaacaaaatgcaggaaacatcagagtgtatcaaattatttttttccatgtgcaatattcaggcaatgcaataatagatggaggtccaggtgaaaatgcttctctttttaagccagctgttaaatgcattaagttttaatttgtacatacagttttataacacttagataaccaaccaaaatatgttatttggctgtctccaatataataagtcatttatcattttaaagttattattcacttattagccacatttgcttgaatgataatttaaaaagtattccaaggaagaagaacaaaggagaaatactttaaaaaaaaaactaagtaatttattccaacaaatcagatttttctgctacagtctgttaacctgtaacctatctgaaaggtctaaaatattacatttttatgagacattttgtgtggaaaatattgttgcctattttgtacttcattcgctttacatgaaaataagctattgtgtgctaaatgatattatataattctattgtaagaactatgctcaaactaaaatgttaaaaggtaatatgtacagttatgtatttatgatatatattctgcaggatttcagaaaagatttgataactttcacaattataaataaggaacagaacatagtactcaggacttagaataaagtaaatactgcattaagcattaaaattcttgggaataaaagaaaataagggaacagatgtatttcctgatagtctaattatcagaaatatgcaaaataagctgggcatggtggcttatgcctgtaatcccagcactttgagaggtcaaggtggatggaatgcttgagcttaggagttcaagacaagcctggacaatatggcaaaaccttgactctctaaaaaatacaaaaattagctgggcatgtggcacatagctgtagtcccagctacttaagaggctgcttgagaggctgagcggggagaatcacttgagcccgggaggttgaggctgcagtgagtgtgattgcatcattgcactgaagcctgggcaacagagtaagaccctgtctcaaaaaataaaatgaaataaagaaaataaaagaaataagcaaaatataggttatcttatttctaaattacaatgtaaattaatttattatgcattttttttgcacgaggcaatcacatcacaaaagacaatgtttcaacagtagtgttacagatttgcaggcagactttggctgcctatgggcaagtccaaattttttcttaacacagaaaaagaggaactcatttaagtatctagacacatactcaagtaagattttagaatttttaaacatagaacattacaatcttaggcctggaaaatgctaaaagcagatacatttaaatataagaaaatcctaatgcagtagaaattgaattgttgatgttccagtcaatactgtagaaatctgataaataacagcagtgatggctaaaagacctacccatcagctacaaaaagagtttccgagagtctacattaattatcatattagatagtttctattaagtgattgaaaattggaatatgtctgtcccaaaattgttttgccatagtacccatgttttatagtgagctggatatttccttttgttctttcttcattcttttgttgttgttgttgttgttgtttcttcctgttttttacttgcttctcaatctcttctatcacttctgtttctttagaattaataaattctaaattaatagaacatttggttacttattattccattctcacattgctataaagaaatatctgagactgtgtaatttataaagaaaagaggttcagttgcctcatggttcacaggttgtacaggaagcatgatgctggcatctgctcagcttcggggaggcctcagaaaccttacagtcatggtagaaggcaaagggggagcaagcacctcacatgaccagagcaggagtaagacagagtgaggagccacacacttttaaacaatcagatatcatgagagctcactatcatgaggacagtaccaagggggatggtgctaaaccattcatgagaaaaccacaccacgatccagtcacctcctatcagtccccacctccaacactggcaattacatttcagtatgaaatttgggtaggaacacagatccagaccatatcacttataaaattcataattcatggtaccaaaaccttttaatcaaaatgaggcaaagtacttgttttactcaacagtattaaacatgtaagcattaagtctacctaaaaacaaaattgaagaatgttacatgtgttaaaaagacgagaaattaattcatataccatttcaacttgaaatttaagctctagaaagaccattctattctggttatataacagttttattatgctgatatactatgatacagcttaaatcatcaatatgttagaaatctgatcaataccaagtctcttagtttggctcacatcattggaatcaaaggttaatgtcagatcaacaaacactaaagaatcttcgatttttcataattttccatcagtgaaattattcagagtgcagcagtgatcagtggtcagaggttggtatgaaaacattcatgttgttgtcaagaacattagcatgaaaaaaacagatctaaggtttatcaagggaaaaagctggaattttaaaaaaccgaagttttagcttttgatgaagtagaaataaatgtgtccatagaaactctcaaatatcaagacaaaattgtttaacaactaaggtagcaaacatcaaagctcaccactcagattcataactaacatttctggtggcacaatattttttcttttttttaataatataccttacctagaaagaatacttgggccctttaatatatagtataatagtcataatacaataaagtcaagtgtaatatctcaccctgatatcaatagatgtttaaacgtcttggatttttttttttttttttaacgcagtctcactctgttgcccaggctggagtgcaatggtgtgatcgcggctcactgcaacctccgcctcccaggttcaagcaattcttctgcctcagcctcccaagtagctggaactacaggcacacaccaccacacccagctaatttttgtatttttcttgggacagggtttcaccatgttggtcaggctggtctcgaactcctgacctcatgatccacccgacttggcctaccaaagtgctggcattacaggcgtgagccaccggtgcctggccatgtcttggatttttaaaaaatgcttatcacacataacagtattcccattatatattgacgtgtgttttgtcctaaaaagtaagattcccattgcaatatattataaattgtaaatcattgttttagtcttagatttccttgctcacattatcaagctaggcttttcagggaagagaaataaggcggccaagacggtgaaaccccttctctactaaaaatacaaaaaaaaaaaaaaaaaaaaagccaggcatgttggcgggcacctgtaatcccagctactcaggaggctgaggcaggagaatcacttgaccttgggaggtagaggttgcagtgagccgagatcacaccactgcactctagcctgggtgacggagcaagactccgtctcaaaaaaaaaaaaaaagaaagaaagaaagttgtttaggtagcatctcagcttgctctatcaaagctgggattgtgtggcagatgctcagctgtttggcagttaggagcagttaagatctgtgatcttttgcaatttggagagtttcccattgtacagtaggaatggaatgttaaaaattcctagtatctcacaacaaattttttagtagacttggagagaatttgtctttgtcttcacttttttatttgtatctttatttgcttagagacagagtctttctctgtcacccaggttgagtgctgtggcataatcatggctcactgtagcctcaatgtcctcagttgaagtgatcctcccacctcagcctcctaaatagctgcacccagctaattaaaaaaaaatttttttgtagagatgggggtctcactatgttgatcaggctggtcttgaactcctggactcaagcaatcctcccacctcgacctcccaaagtgctgggattacaggcaagagcaactatgcccagtctttatcttctttaattgcacattcacatggttttcaaagagatttgggtaaaaataatattacatcaggaagaagaaattaaagaaggctatggtacttttaactatgttgaaaataccattttgaagaacagagataatctatgaccccaaaattttgattagaagtataagtgaaatttatcatttatgggtggtattttaataatattatgttgtgattataaatgagtgtggccaaatagtgtctccttttgttcaataaacttttccctaaaacagaggcaatcttttcaagttatattttctgtaaaagtagttttgtcagagccatgctattttagtttgaaatctcctaaaatgatcattacttactaaatggttagactatcttctttcaaaaagctcaataaattaaaaagcaatacctgagtaatctgcatacattttaaggaatattatctgaatagtcttaccaggaagttgggtgatactttttaggtaatcgttttgatttgtttgtgattctagtattaagcgaaatcagtatggctagccagccttttcttcttccaaaattagtttttattaactaattttaaaaattcaaaactctaaagcattaaatactaaggaattcattttttaaatgtctgtcctcttgaaaacaaattatcataatatttttaaatggatgattaccaagtagcactctctctatttaagtgttggtttgctaggtttaaaataaggattcttggtcactgagaaatctgttccagaaagctctatggcagggggatgagagaagtcaaatgtaactgagagttgtgggtgcttatattgttgtatttgcttttaatatttggtggctagaactcctagagttaaacatggactaaagtacaaacctaaatatttcccagatcctcttggggatgttaataaatacggtgttagaaaaagttttgtggcaaattggtttgggatgttttgcacatcactgcctttgcctgagattcaaatatccagtagcgtatcaaaagctttcagaaggctcatagtgttcctacccacgtagcttagcatctcatctgaacactttacttctgtggtcttcctccccaaaacacataactttaaactaatcattacaaaaaacagacagatctcaatagaggggtatatgatttatctgattagtactcatcaaaactttcaaggtcaaggtcttaaaggaacctaaggagacatgaggactaaatataatatagtaccctggatcagatcctgaaacgaaaacgaaagacattaggtaagaactaaagtaatctaaataaactatggactgtagttaaaagtaatgttcactaattatataaatgtaccatactgatgcaaaatatttcaaatagggaaaactgtatgcaaggggtagatgggtaatctctatagtatctgcttaatatttttgtaaatttaaaactttcaaaaatgtaaagcctgttaactcagaaaaagctacatcaacaaggcatgttatttacgtgaaactttttctgtttacaatgttctctgtgtacacaaaataaattgggccatataagaatatggaaatcttaattaagctctttggtaaaacaaacaaacaaaaaagaaataaaagcatgtaaagattaggatactgatgtaggcaagaatctatcagtaaaatgttgtgatccaaaagttcacaattggaatctagataatttcctcaatccttcacatatatgaagatgccacaactcagcggaaacacaatgcttaggctacccaattagatcttttgatatgtgactggaagaaaatggcagaatggagtgtagaacactgcagaatggtttttataaaaagatgtagctaatttttcaatgtacacagggagaggttaattccaaggatgctctcttctcattaggctaccatgtctggtacatttaccatgcctgtcttgggatatccattcatccctacacaatatctggggacggatttgcaagtaactctcattattgtactcaccaagttttcaggctcctattcctatgccaatgttgtatatgtaatgaataatgatataattaacaaacaataacaaatgtaataactactgtttattgagcatgccaggaactgtgttgagccctttattttattctgtttaaacttggtaacaaaccaataaactaagcattgttctcatttaatagatgagaaaactctcctgtgcacacaattcttttcacatagttagtgaggtagcgatactccctgatttactcataagcccttcaatcaatgttttaaaacctaaatttttacatcctgtttaaatatgttcttagggaaaataaatagagctgttttgagaatcagttttgggagagatttggtgctgcagtcaaattggcttaaatgaattaactcatctagctcttcctgctatgaacagaaaatagagagagcggaggatagcaacaaaattcagttaaaaaacccccagacaaatgcttgttagtaatctgatgggaaaacttactttatttatactttctccaaacagagcttggtagtaagaagtgtatttgtcttaatataatttttgcttacttttttggaggcctttgcttgagatacttttttggaaaaaggaagatgttcttagtttccatcaaagacagtgttgcctgtgttgtcatccttactgtggagacgataagccatcaataaggctgcatggtgggcaacagctttccaaaactgagtggtgaatcacctcttttcaattatatatctaaacttggtaatatcagcttgtaagagaaggtcatgcagtatcttccatccaattaacatgtatagaacacctcctccacaactcattcatcctttgctataatttacaacttcctgttgtatgtcaatggttttaactttttcagatcttatttgatttagctgagaaataatgccataagataggatgtaggcctaatgctatatttatttcctttctctctgtaagatttacattaatagaaaatgtcatttcctcttagtctatagatagggtccaggaaagtttatcaaaaaaattaagttaaagctatctttctttctttttttttattatactttaagttttagggtacatgtgcacaacgtgcaggtttgttacatatccagaaaagtgtatctaccttcggctttaattgaacacccttgaaaccaaaacggctaatatgttagttattgtcttttctagatctcactaaaagtcatgatttaagagagtacatgggataatttttcatggtatagaattcctgctgtcattcttcctcccactttttctagcccgttttctcatactgcagattttccctatgctgaaggattccttgactctaccatacagtcaacattcaagaccataattaaatgaaagttcattaagatgtatacctaaatgccaaacactagttttttttcattgttgtttggttttttgttttgttttgttttgtttttgtttgtttacaaaaaggaatatgtgtagaatgacattgatcttattttaaaagaactaatattccagaaatggtctgtaaaactcaagatgaactaattgacccattcttgatattaaacataggttattgtacatgttttctttgaccatagaaagccacacggtttgctacaaatttttcctatcttggtacaaccaatatcagatcagaagatttccccaaagtaatagctactattttttctctttcagttgcaggagaaataacaaggcattgaagaatggcagatgaacggaaagatgaagcaaaggcacctcactggacctcagcaccgctaacagaggcatctgcacactcacatccacctgagattaaggatcaaggcggagcaggggaaggacttgtccgaagcgccaatggattcccatacagggaggatgaagagggtgcctttggagagcatgggtcacagggcacctattcaaataccaaagagaatgggatcaacggagagctgacctcagctgacagagaaacagcaggtaactaagggctctactgtcaccaagtgcttgctttgtgctttgaagtcagtttagtctgaaagtgaattaatatacagcactgatcctctttcactagtgctaggactgaaattccagtcagtcagaggaaataaaagaagagaaaaatcatggcaactaacttgacatttccccacattatctgtattctcaatcccattcccctatttaatttttatcacgtgaatttttgcaggctgagtatatgtatgttttgctagaaactgtcagcattttaactcattgaaagaaaactttacaaatagtttttttttaattctcttaaatgaccttggacctaaatccaatggattgattagaagcatattttttagagcagaaaaaagcaaaatacgtaaatacatactgtaatttttttaatccatcattcaacaaattacagtttagcttttctacatgcaaggtgttgtgttagcttctgtgccagtgcatgtgcaagaaatggtcccagaacttcatgaatcagatgatcttggagcagacatgagacttgtgcatatgtttatttggatacaaagcataacatgtaagtgccacatgagcagtatagaaaggcaaagtttaaagcagattatttctgctttgggccaaagtccccaaattgtgcacaaaatcatcttatcatcttggggtgctgcagcaaattcacaagaatacaacaaggtattttaaatatttaaggggaacagtgataatatctgtcaaacactgcctgaactattagctcaagatagtttacagtttcaacattacattacactatattcctttaatatgtcatatctttgcaaaaataggttttcagcagttgttctgataaaagcaagtaccctgcagaaatccatgtgaaatggaagaagagagtgatagtgtccaacctgattccagggtttgagatactgtgcagtgccccacaggcacatacattcaattagtatgaaattgtggttgagaataaaataaaaatattatttgcacatttcatggttacaatgaggattaattaagatagtaaagtgtacaaagtgaatggctcaagaaataataactgttaattaattttattattattggtggtagtggtggtatcaatatggatgacatagcactcttgatcaagtaatatttttctatagctgagtatacacaactttaacagggtggaacttgggtgtcaggagcactaagaggattttcaagggattgcagcatgaggagatgagagcatgttatagcatattgattgtgaggaagaaaagagttagtatgatatgtcaaggtttttttcatcatcgtatcttgcagcattagaccttcaatattccataaatgtgtgttgagtgagcgagtgaatgaaggaataaatgaataaattcaaaaagaagaaagtcctcttcacattaatgatgaaaacaattgaaaagtcttactttgtcccttgggctctcgccagttgactctcagtgcctgttatgaaagcttgtaatacacaaaaaaaaatcactgcagtgtgcttggtcatgcagtaaaaaccaacaccattcactatttcatctgttcagtggtcttaagtatttgagagcatcagaaaaatctatttgtcaagtcagtgtattatcaccagcttctctgagaaaatgatatacatttaaaagaggctaatagacgtttcttttaaatgatgggtttaggaacatccagagttcattttaaattcagctcaatgtgtatcaaacacatttggtattagcttttggagattgattacaaaggttttgtctgtatgttctgagtgacaaaaattgtaaacagtcagccatgggctaccagagtgatagtcaatccaaactaaactatggtgtgatttttaaattaactttcctctagaaataagcagccaagtattgaatccatgagatatgcatgtgtagaaatctttagaaaaaggaaaatgtaaaataatatcttttcatgtctacagaggatgttccagtgatgagttaatatgcaattaaatttatttccaaactctaatttaacaaataacaacttttatcattcatggtttattgacagctgtttcacaaattgtgtaataaaaatcatctccagcataaacaaatgctcttaaatcccaaatatggtatttagaaatgctatcctttgatgatggagactatagatatgagctggcgtaatattttgatgtgattattttaaaaaggaccagggatctatacatcagctcactcttttatacaatctaccagtgtattacatttttccctataaaggatatttctcaggacactgttagcgtgaggcacttctcagtgacatcaggtccacagctatatgttgtaatatccaggacattactgattaaatcaaagaatcttccctctactttccgtttttgctatagtcccctctttgcattttaaaataatattttctccaagtttgtttctttttaatcatttatataaataagatcacatgataaataaaatgcaatcgtcatcttcttcccccttttctccttcattagagtgggctcacttcaaccaagatccttacttttttccccctcatccactccttcaatgttcatctttattatgggcaataataatttttaaagatgcaaacccatagtcagtgtatccttgatcttatgcactgacaccagagggtgggagagtggagaatattagaaggcaataataatttaaattggctgggtgcagtggctcacacctgtaatcctagcactttgggaggctgaggtgagtagattgcttgagcccaggaattcgagaccagtctgggcaacatggcaaaacctcatctccaaaaaaaaattagccgggtatgatgtcacacacctgtggtcccagctactcaagaggcaaaggtgggaggatcacctgagcccagggaggtcaagactgcagtgagctgtgatcaggccactgcacttctgcctagatgacagagcaagaccctgtctcaaaaaaaaaataataataataatctagattttgtccccttttttatgatttaaaactatccataaaaagaattatttgctcaactgtagcataatttttcattccttaagattttttcttaccactaaagtgtgctttttggaagccatgccacagaagcatgaaaaaaagaaatgagaaactattaagcatctagccacttaggaaagctgtcgttataataagtctaaagcgtaatttttatctttatctttgttttttgtttttaatttttattttcatggattcaggggatacaagtgcagttttgttacatgaatatatctcataggggtgaagtctgggctttgagtgtacccgtcacctgaatagtgaacattgtactcaataggtaatttttcaaccctcacctctttcccaccctcccgcctttttgagtctccaatgtctattatttccatatttatgtccttgtgtattcattgtttaactcacacttgtaagtgagaacgtatggtatttgattttctctttctgagttatttcacttaagataatggtctcccgttccatccatgttgctgcaaaagatatgattttattcttttttatggctgtgtagtattccatcgtatatctacactacattttctttatccagtcatccactgatggatgcttaggttgattccatacctttgctattgtgaatggtgctgcaataaatatatgagtgcaggtgtctttgatataatgatttattttccattgggtagatacccagtagtgagattgctggatcgaatggtagttttattttcagttctttgagaaatctccataccgttttccataaagactgtagtaatttaacattcccgtcaacattgtttaagagttcctttttctctatagcattgttaacatctgttgtcttttgactttttaataatggccattctaactggtataagatgatatctcattgtggttttaatttgcatttccgtgatgattagtgatgttgagcattttttttcatatacctatttggccatttgtgcatcttcttttgagaagtgtctattcatgtccgttgctcactttttaatgaggattttttttttcttgttgagttgtttgaattccttagtccttcgttggatgcacagtttgcagatattttctcccattctgtgggttgtctgtttactcttttggttatttcttttcctgtgcagaagctttttaatctaattaagtcccattagtctatttttgtttttgttgcatttacttttggggtgttagtcattataattctttgcctagggcaatgttcagaaaagtttttcctgggctttttttctaggatttttatagcttgaggtctcacttttaagttaaagcatcattttaaaattgttttccaaagcgtaaataataagagtaatggcttgtaataattctttcctctcttttctgtgttatctttattgaagaaagcaagaggaatgcattttggtccccacagagtttcagctctgaagataactgggagcctcatccttaagtttcagttccagggttggggcccaaactcgtattagaacttgtatcaagatcttataaaagggcaaaagggattatttgtaaaatttgtaaaatattgagtggaaaattattttagaaaatggaaagtgacctttcaaattttaagggcacagaaaagcaattgatttctgtaatcattgtgcatgtgacttaacagtgtaattggttttgacttcatctagtattcccttaacagtattatatcaaatcctatctttactgtgcctgtttatagaatcattttgaatatggtactttctagcagcaaaaacagggatgtgcaaacaaagtggtggttctatgtttctgaccttgctctaaaaaagtaataattttgctgttgctcacttttcatctaaagagaggaaaaaaaaattattattattactattttttttttgagatgaagtctcgctcttgtctcccaggctggagtgcaatggcacgatcttggctcattgcaatgtctgcctcccgggttcaagcgattctcttgcctcagcctccagagtagctgagattacaggcgcctgccaccaggcctggctaatttttgtatttttagtagagacggggtttcaccatgttggccaggctggtcttgaactcctgacctcaggtgatccacccacctcgacctcccaaagtgctgggattacaggcgtgagccactgcgcccggccgagaggaaaaaattttctaatttctattcatccctcaagaattgcttacaaaactattatggaaatatatataaaactacagcttagaaatgtgtgtagaattgcaagctgccatagtgctcttcagtttataaagcaccgtcatatcttttatctcatttcatctttttgcaatttccatgaggatatctgtcattagtgtcttctttttacaaataagaagactaaggcacagaatggctgagcaacttgcccattattacacagtaagaaagtgagagaggtgaattgtgaacacagtgttcaggaatttcatgcaactctcttctcaactgtcctaacctcaagaagtggtatggatttttttttctatagtttataatttacttggctttataaatatgctactcattgtgaaagctttcaagactcttttagatgagtgtatttttttttcttgctctcaggattaattttgcaaatgtcaggatttgttctttattagaaaatcgtggtgaaattagctacttttctatcacagttgtggatgatgtgattgaaagctggaagggaccagtgagatgacttttcacagtagataatatgactactaccagaatgcaagtctcttgccctacagaccagtgctgtttccactatccccatctgccacattcagaacagcagttagttgcagcagttatcgattacaggcaaagcagacaattcttctattccagaactgccacattcatgtaattttaagtgatatgatatcataactttattcctagttttcaatctgagtagacaaaaaggggaggcaattttgagatgtttattgatactaaaacatttttaaagtatttaaaatcaggctttagtgatttttgactatcttgaagtacagtgctgtgaacactagtaaaaaaaaaaaaatgctgatcacagaccgggcgtggtggctcatgcctggaatcccagcactttgggaggccgaggcgggtggatcacgaggtcaggagattgggaccatcctggctaacactgtgaaaccccgtctctactgaaaatagaaaaaattagccgggcgtggtggcgggcgcgtgtagtcccagctacttaggaggctgaggtaggagaatggtgtgaacccaggaggcggagcttgcagcgagccgagatggcgccactgcactccagcctgggcgacagagcgagactcagtctcaaaaaaaaaatgctggtcacagtagaaagtgcctacgtgacgatcaaaggccagtatcagcaatccccttgggtaaatgtaaagattaaaaggcaattcctcactataatccccacaatttaccaggattcctttgtctccccatcatttccaggcatgctatccagacctacccactgccaaagaggcaggaatggaaaagcttttccaggctttgcgttgtcactttttcagggagctcaccatgggagctatgtcttataaaatctggccctatactatcacatccacataactccagcagccaagtgaccaacactcagttatatacatttattgttgctgcaattttttttttttttttttttttttttgagatggagtctcgctctgtcgcccaggctggagtgcagtggcgcgatctcggcacactgcaagctccgcctcccgggttcacgccattctcccgcctcagcctcccaatagctgggactacaggcgcccgccaccaagcccggctaattttttttgtattttttagtagagacggggtttcaccgtgttagccaggatggtctctatctcctgacctcgtgatccgcctgcctctgcctcccaaagtgctgagattacaggcgtgagccaccgtgcccggcctgctgcaattattattattattattattattattattattattattattattattttgagaccgagtctcgctctgtcgcccaggctggagtgcagtggcgcgatctcggctcactgcaagctccgcctcccggattcacacccattctcctgcctcagcctcccgagtaactgggactacaggtgcccgccaccacgcccggctaattttttgtatttttttttttttttagtagagacagggtttcactgtgttatccaggatggtcttcatatcctgacctcgtgatccgcccgcctcggcatcccaaagtgctgggattacaggcgtgagccaccacacccggcctgttgctgcaattattaagtttgaaaacacatgaaggaaaagtttggcagctctcacatgcaaaaagctgcatatgcctttaaataaagcttttctctctgttctgcttttcaatctcagaagattcaaatctatcttttctcacctcgccctttctcccctgcctccgtttctagatttgcgatttactaataggagtcagcatcccatttaaaatatggcctattctatgtaatatattaatttatgcggagcaaaatagcactgagccatttctcctgcaaaatgactaaagccatccacaccaaccccccaagcaaataaacaagctcgcctaacaatgcgagaggttgcagattttcctttcctagttgccatgccaaccactcattgctctggctgccatttccctgagctccgcagagagaggagtgtgcagagcagagttatttagcattcaagggtggatctgcagaaaatcacacagcctcactgcgaagcatctgggcctggtggcaccgatggatgaggacagaaaatggggatcttttcagtgttttccttctaaaggttaggcatccggggctagaaagagtgagaaagacaaggattgatagaaaaggcagttccacgaggtttgtattgtcacgtttgctttgtcctatgtggtctctctactaggtgaagctggttgtggggattagcttcaatcataatatttggcttggcttgttgatgaataggatttgaacctaatttagggctagcttatatggatattataataaagaattgtgtcttttattcttgatacaatatgaggttgtatatagcaggtattgccagccacagcgtttgatattttacaaattagaggaaaaaaaccaacatcagataaagttttgtttcattgtacagctataaggtagtttgtcccataaaaatctgtctttgctctgtagtccagtcttaaggtaggatgagattttcttaagacggtaattcttaatcgatatatgaggaaaacttggtttctcaagacttgtttccattaaaccctatgactcaacaaattaaggtatgattttattccttggaattttaattgcctacaaacacttcaagttgtgaagagcaaggctctatctaacacaatataataggatatttaaaaactgaggttaattgcattcacatgtacttctatgtgtgttcctcaagaaaattcctcccatgcactgtggaaatcagtctcgtttcttgtctcgctttgtgctaaatgtcagaactacatcacaagcgcaaaaagtatttcctcagacgttttggtccactgacattttaaaaattattttgttgaatttgaatcttaacgaaacagatttttgccaatgacaattcagacctatttatgaaaattattctttctagtttgtttttaagtgcaaatataatttaattatcattgtaatttttacttgacctttctctcatcccattttttccaagatcttgttaagttttctctcctctaatatgctgtcatgttttgtcatcatatttttcttttaatgtttttcaatttttttgagatttaaaaaacctccatttagataaaaatttaaaacaattcttaaattctttttttatttttagcaaacagatgaaagtaataagtaatgggagtgagtcttctagactcatttttggactgtctaagcctttgttttggttaggattatgcatggcctttatctgtcctttgttatatttcggagtattttctcctcacaaaagagaaaaagaaaaaaaagataagataaaaaatctaatacttttgaacaaataaattgctcaaatatcttgagactatatttcttatcaagcaataatgtgtttttaagtgtgagatatatatatatatacacacatatatatattctttgattatattacttgtgtaggtctgagaaaaatgtttgccactgtatgccaaatgctgccttgcggtttagaattgggtttgattttattgcggttgggaggttattaagtagactggagagtacccagcagttatcactcctcttttttcccctctaagctattgagataaactgactctttctacttcagtgtgtcaagcctttttctcttcctctcattccctcacacttcactgctccccagtacattacataaagcacgtgctttgactgtcaggggagtctggaaatcatatcaggagaggatgaacagaacaactggtgctgcattgcagacctggtagcttcagcattatctgacctggcatcgtgagtcctgggggaaaaggacactaaaccgtgtcctgccggctcactgtgtagctcgtctcactgaatgagtcaccattcagcaacactcatagaaaatacagttcaaaaaccagccaagctgatgagcagaggaaggggaaaacatatgtcataggttgtcatgcaacttttaacaatgcttttaacaatttttgcaaatgctgggtggttattagaacacagaaatgagagtaaaatacagttgatttcaggaatacgcaagaaggcattaggcaaaaatagataagaaaggaggaatcaagattcagagaaaaatcatcctaaatacatatgattcagtttaagcatcctgaaaatccatatttttaatttgtaaacacaggtcaaagtgatgctggcatatgagcacctctggttcttgcaaagcatctccagcatgaatgatcagtcctccgattggtctaaaatgttctcttttgtgacacgttgcatttgccgaatgtaaatgggcaagtttacattgtggtgttttcattcccatgcagtattgtgcaagaagtcataagaaaaacattttggaagggtaccaccctacagcaaaggttctcggaaatctaccattaaagataaagagctgttgttgattttattctctcaaatgagtcttcctcttctgaacacccccaagtaccatgtttatatcttgctaatacaattgatcatagcaatcattttactgaggttacttgttatttgtttttattacagtcagtaggttggaaatgctttggggtagaacctgtgcttcattcatctttcttttcctttttgtatataacacagtgcttattttctataatatgtatgtgctaatacatattttttgaattaatataaagaagagagggctgggcatggtggcttgcgcctgtaatcccagcactttgggaggccaagatgggcagatcacttgaggtcaggagttcaagaccagcctggccaacatagtgaaaccctgtctctactaaaaatacaaaaattagctgggcatggtggcacatgcctgtaataccagctacctgggaggctgaagcccaagaattgcttaaatccaggaggtggaggttacagtgagtcagatcacgccactgcactccagcctgggcaacagagtgagaccctgtctcaaacaaaaaaacaaaaagaagagagagtatccatatatagttctgagaatggaaatcacataaacaaaatggtctacaaaatttatactacattgtgaacaataaatttgcaggaaagactgtattagaaaggaaaaccgtggctcatgcctctatcccagcactttggaaggccaaggcaggcaggcagatcacgaggtcaggagatcgggactatcctggccaacattgtgaaatcccatctctactaaaaatacaaaaattagctaggcttggtggtgcatgcctgtagtcccagttactcaggaggctgaggcaggagaatcgcttgaacccaggaggcggaggttgcatgcagtgagctgagatcgcgcccctgccctccagcctggtgacagagcgaaactccgtctcaaaaaaaaaaaaaaaaaaaaaaaaagaagaagaagaaaagaaaggaaaactgagaatgaagaggtaatcaagaaactgaaaacagtctagattcaaagtaaggactttaaaagtgtcggttagaacagaaagaaattaggtaggaactccaaaatactgtagtgaaagtatatggtggaagacttgacttgttctgaaattgggagtgagagttgggagtaaagaaaatatatctttgactgaagatagcagtaagatatcaaattggagatattttcttgatgatgaaaattactgagctgaaaataatatgaaaagtccagataaatgaactttctaaaagataatctagtggttaagaaatacatagatacagaaaaatttttcatgttcatttctgcagaattgaggccagtgtaataattggcttaggttgaaaatgccactgaaatattctgtaaatggaactctataatgcatgtcttttttgatcctctgactataaataaggattgctgcactgttctaggtcaagtaaatctcatttctgacaaatgggcaatctaaatcttaaagcatttggatattctaagtcatggatttaatatgtgcctcctttaaaggagtataccagtatcgtcttggaaagatattatgtatcctatttttgaagaccaaatgtcaccaatgccctttattttctctatttcatctttgagtgcataaaattatttgcaaatgagttcttagatagtaaacaacattatcatatcaaattaggaatttatacattaactttaggaaaatattgtgatttcagttaaatataattccttagtttcattttagttttcatttttcacttaataaaaagcttcctgtgatccataattttcttttcctttgacatatttgaatgaaaatgctcccatttacattttctaaatctaatcattaagtatttcagtgtttagtgaaattcttctccaaggaggaaactaatagtagtaataataattattgacttacttttataaccacttttaaaaaatcaattcactggatactttttctccttgttgaattttgcatcttcagctcatgtttatttatgtctttctttaaaaattggctttggttgtttttctcatcagcttgaaaaatagaatttgtgactaaagcattaaaaaaattggaataaacttgctttccttcgagctttactggaacacaaatgctgacctggggaaagtggctttttctccaaatattgcactaacttggtgtagatcacaacgcatgtaagatatttattttctccaggccagttctcatctaattctttataaatcctgattgctataagaaaagaagcaaatgattgagtttgatgcaaatatagtagccacttaacaaaagtcacattttaagagaggaagttcattcagttgggataacagtagaggataacagtagaggaataacagtagaggaataacaagaggataacgagaaaggaagttcattcagttggaataacagtagttcccttctctcatctgccatcctgaagaaaaatgtgttatgaaatgctctgcagaccacatttatcttgctcatatgatcctaatacaacatcaaaaatactgctcaaggaattggctattttggtgacacaggtttcctttctagttggatttcactctttaagggtgaacttaaattactctagctgactatcatcttatgatggaattactagatacgtttgaatttaatttttttatgtgaagaaaaaaattttatcatcttatgatggaattactagataagtttgaatttaattttttttgatgtgaagaaaaaaactcccccaaattatacttatttttaaagtaaattttataatatcgagcattttttcaattctaactagaaatgcttgaatctcctgaggcttgaataatggcaagtttcaacttttgcctgtgttctttgatacaactgaatgtggaaaaactacagtatgtaaatagaaagtggttttcttcaccagttctgtgggaaaatgaaaatacgatatttgctttttaaagagtattttggacactctaaactctatttaaaatgttgaggtatttcttgtattttatgctataaaatttcagtaagacactttaattaacataatgattgtattaaaaccatacttctcttcctatagcttttgatcaccttctagttgttttcagatcatgtcattcctgcctctttgtttcatgtgtgcatttcagaactgtccaagaaaaagagcaaaaacaacaaagttctctggtttcatgagagtttttacttttacagttttttttaaagaaaacaaacccaaactacaaactcacataaaatatttttggaaggggtggtctctgtaaaagttgggagaaaagtgactgataaactagcaaagggaaaggaaaggaatctgagaaaccaagctatttttaggcatattcttagaaccgagaattggtcaactgcttcatgatcagggctcctgtacatgaaatactgacattgtaatttcattttgaaaaacaaaggtacaagtcctgatttagaaattttccttatatgttgggaagaaaataatatatttttcatatattatcatagtaaattgaattttcattgtaatattttcctgaaaatttcagggccttttaatgaaatctgattttccatatcctcaacaagccccaaatgtctattccataagattgtgattctcattccaaatgaagctctgtctttgtagaccaagtatgttgtatgggtatagtaatatctgcctacctaggaccggccctatgcagaattagaaagtaaatgaaacatgacttcagcacttttctatctgcttccccaatcccttctcttcattttcttcaagtcagcagtcatatgctcatatgcctaaaatcccgcataaatcccattacaaagcttaatctccttgccctatatcaggctacctacctagatagcatcctgttcttacatttttctcaactctaccactccatcaaattttatctacctttctctttctgctgggctcctacaataggacaaccagagctatttcaataacaagttacagttttatgcttctagatatcatttctattctgatataaaacttcattgtcttcaagtaaagagtgagttctttggcaagtataggtataatagagatggaattcatgctttgaaggtatttctagaggtgtgcttggtatcaatgagaagcaatacagtggagagatgcagctatagaaattgacatgaataaacaacattgaagcaaaatcatcaatgtaaaattttatttcaacaaacgccccagagatattttctaaagatttgtatgctatttgcaaatttctcaaggtgcatttgaaattattatttgttttttatttgtcttacataatgaagaaataaaattgaaaaatgtatttaataatattttccatggggtgcatttatcaatacagagtctaaaagaaatcgtctttattctagaatatttttgacatgaagaaattttaaaattctattaaagtctttgctttttactgtcataatggcatcgaaatacaaatatgacattgaccttacccttcttgctgtaaaaagaagatttgcaaagtctgttgattttgctacgtacaggtctggcaaaaagtattttaactatcatcaattttacatatttagaatttttccagtgaaggtgctccccttctcttgggttgtggctgagcttttattttacagcattattaaagaaagaatagtaggatggttcaaatttactttactttcttttgctttttcttaagtaggtatttcagttttcagaagttcatagtgtaattgatttcactgtacttccccccataagattactgaaacatgattatctgattatatattcagttatgatttgaaaattacaaagaactaccatgtctatttaacattgacttttaaagtctgtcaagtcatttcaggtgctggtgtaaagagaatctttgcggacaatacttttgtagctataatgatataaaatatgcaggtatagaaaatgaacagtcacttatttacaacattaatagttaatgagaaacttgctaagaagaaagcagataaggttgatgattgctgctatttgcgaattcttagaaacgttataggacgggaaggaggtttaagtgaaatctgattacgcagaagtcatgttggtttttccatgtgaacattgagtgtaccttctgatgtattttgaacaaagtgatttttcccatcacatggttcctaaattccatatgcatctaggtcacaaggcttccaaagatttctaagttatgttggggatgagagagaaggatcaaacaaaagttagctaagctgctgatctttaccattttattgtaacaaatatagtttctcctagaagaaagatctgtgtttacagaggtaactagtaaagactattcttggtatatagagaacttaatttcaaaagtttattccaatgacatccttttagaatgtagaatttttttccatcatatcctgtctcaggccagcattggcattcctatgttttgcagctatagaagcattgatttctccataagaaaccctagccttgctccttgtgcctaagacctgtgaggtatccatgtacagatgagactttaaaagcatggacagacctctatgtgcatgagtcctaacatgtgcatacacacacacacacgcacacacacacacacaaaattgcttttccacaaacccactatattttatattttgtttatctcacagttactctttctaggggtggatttattcaaggtctctttgttttattgatattttattttcccactaatatttaaaatgtatcatgctacattcctttagcaatgtgatgtattttaagacttaatgaagagaatataatccaatttccccacatctacaaagagtagtacaattgtaacagttttgacgagatgcaaaacagaacatttcaaagttccaaaagtactgtcaattccctcagtgccttaatgattggattcaatttattggtgttaaaactattgaaaatttcaggggagcaaacctctctaggaatttctctttctcaagttaagattgataaaatattacaaccttagttaattagtaaatatgtaatataggggctacaaacaacataaacatgcaatacattactccattggacacccccaaaaccaccaccagcagaacactttaactagaacatgataaatataaagctaaattgtaacgatactggcttaccatatttcttctgcttaaatgtgttttctgtttcctactttcagctgggaacttaaaattagaagcaaaattttccagtaggtactatctctgatctgtgcttttctaattacctttgactccataatgtagtgtttttaacctgtggtgtcctttcactgataatagtattaatttactacattttcctccttgaccaaatttaaatgctaggccagttctattaaactctaaagacttcatttgagtacattaaggtataatctaaacaagattgtgggtttgagcatgtacgtggaggtagaggaaaaaaaagagcaagagagggagaattctcctatgattatacactgtactcacaatcctagtctaccaatttgtaaatccgtttcagaagaggaccatatgagtgactgtggcgggatcagtcaaaatttgtggccactactagtaaatcttgaagaagaaaaataaaacatgtccttgaacaagagtgcccccctttaaacacaacttaaatgtaggaataccatatcttactcatctttctatcccccactagtgactaagaatagctccattgtctatagcaggtgcaaaataaattctcttaaatttaagtacccatcagagctgaattttgtgccatcataattcttttatcttaaatgcatttgtcttcgttaactaacttcgcctcaaatgcatttttccccataaaccaaattgatccttgttttaatcgctaaatctttagaagaaatatctggaaaaaaaaagctggtggggaaagatctgtagctgcaatgttggccagtgtgacccctgagattaacagaggtctgtctagggtgagacatgccaatgctggcctctaaataatgcaaaggtgccagggaaacaaacaaataaaaacccaacaatttgctcttttaatttccttcatcatcagttgattacaggaaatagtttcagaggaaccatttactctccaaattgagcaaggagtagaagcaaataacttttcttctttccctatttttatgaattcatctagggtctttgtttagcagagtgcttcaaactacacagtgctttccttgttgattagtttccatcagcagcagcaattagcatcggtttcctaggaaaccattctgtaccctactgagaaaaaccttttcttgacaggagcattctgtctaaaattgttttgttttccttcttccacaagcgtacggtaagcttatttgtcgttttctttgaacacaacattattataccaaagattcttaaaacatttacaggcttttatattccatatggttgaatttacaggcactgtctcttacttttctctaacaacctgaaagaaatcaacaaaaatatgttctcaagcatatgccaaggtgcttggattttttttattcacagtctaattggtgaacctttgcacgttcaagtaatcatagctggtcctgctgaaaaaccacagggtacgaattcaaaatcaaacttatgggtccaccaacaatgttacatatcactcagaatcactcagaaacaagttgaaacttccaggatcattgaaaaagtttcatctccattggttatttttaatcaaccaagcaatattgatagataaatgtaacacaataactttaaaatgcgctaaaagcaaagcctgaggttgtcttaaaatttttgttgtgacaagtagtgtgatcagaagagcatggcaatggtgcagcatgaatcagcattagggaaaaaaccagagggtcatgatggctacaaatgctgagtagtatgatatgacagtagggcaaaatttaccttatgttccttttagtttaaataataagtggcaggagcctgatgtattgtctgttagggtcccagcagtgacccaacatttcagcaaggaggtactcattgggaaaaatgacagaataatctcagtgtctgacaaaaactttcagatcttacctacattttgtcaatcaaattatgttcatagatttcatgataagagaacatcaagagtgattaaaacagtggtacctaatttaaataagcacttgatttatattattttatttaattgtcacaacacaccaaaagatgaatactactcttattcccactttacagatgtggaatctgaaggttagagagattgttacttaacaaggtcttttggctagtaagagatggagatggaatttgatcccaggttttctgacactagaacctacttttatataaaatactgatgtaaatcataacaatgtctaaatgggacaagcatatctttatccattattttgctagttttcccatctggactatctgtaaatatgtgtattaaataacatcaacaagaaatgaaagtgcctactgtaacaacttgttatacaaggttgcttaataacgttgtataacagtgtgatgtttattcattagttaggtgagatgtaagtagcctagcatgataccgtttgggtttcttcaagtagtttttggtggatgacagcatttctcaattagtttctcatacatattaatctcctgtatgtgtttccaccaatatatttccttaataccaagaaaagatattatttgtttccagaggactgctttgattctcttttctaaatactgaccccatctttgtttcccaggaaaagttttcaagacagatttcactttttatcttcagatgtttacctggatagtggtgatctgctatcatctattgctctgttgcctagattaaatatttaaatcctttattcttatcagcctttaaccaataacatttttagaaattatgagatgaattttatttagaaaggttcctttttaatgttttccctctaattgatttgtgagcagatccaagttgtcactcatgcatagccatgacgtgactttacaggcatgttataatattttttattacttacagaaattgtctcattatcatattgacactaccgataaaataataacaaattaacattcaaataccaatgtaagggtcttactgcaatgcaaaaactacggttaattacatcaaaaccctgacattcattcacaaaagacagaatggaacattcacaagagaaagaatagaaaaacatattgtatacacttattaactaagataatttctaacataaactaaaaaatgtccagtgccagaacattttataagttcaaaagaaagataattgagcctttcaaaatatcagattacaataagcagttttatgtttgtttaatattttcagctatgaagatcagtgttacctttcaattacatataatgaataataattccccaatttatgtgtaatctagattcatctttaatcttctaacaactaagtcctggttgttataactttacacctatgtttggaagaaaaagcaagaaaaagagaatagaaagtataaaaaggaatagaaggtaggaaaagtaagcaatgaaaaattaaaatgtagtctaatctctgacttcaaaaagaatttttcatgtcaccaattgtcttcagaattagacaggattatcataccttttagagccctgtctagaatagacagtcctgaattgggacttgctggatggaatcttgagcagatggtagcccaggacctatgcatccaggaaactgggtgtgaagccagaaaataaataacaaagacaatatttacttctctcatatctttgccttggaaaaaaaaatacttcccttgtccattaacatagccatcaacatcagtgatattggattaactatattttcagatggttataataacaatagcctagttgggctgacctttagtgcatatcactattgctctttctttaaagtagaaatattaaagtagaagactcagaaaaatacatgactaggggaaaataaagatgtgctggtgaaggactatatagaagtttttattttatttgtattccaggcctgttatataattatttgccaggcctgttatataattatgtaattgagtccccacaacaacctctgagacagatactaaaattatttccattttatggataaggcatcgaagcaaaatgagactgaatacatttcatagtatgaaataactagaaagtagcaatgctggaatttgtacccacattttcctgaattaaagtctgtgagattccctctgatgtgtgctgtaaaaaaacagcaatcagtaatcccctaaatatatagatagatggatggatggatggatggatggatggatggatggatgaggtatttaatagacaaatgtagaatcagtgaagaaattacatatataatcacacacatcataatcattacatttatatttttataggtctgattttttgactgtctttccttgtcttctaagtttgtttggaacatttaccattaatctgccctgaactttacacacactctgactgaatttgctcctgtcccagaagccatgctataaggatgaagctcacccagtagatctgctgatgaggcttccaatgagagaagcccatctcttccttccttaagaatgcttctgtctctgctgatgacagcccttacttagaggaagattttaaattaattggaccagttgaaattcccagaacaatcttaggctcctgtttccctaaattcactgtgaactctatattataaaatgtgacatgccctatttgaaaaagtttaacaatattattctctaaaaagtcttaaagataatatgtcaattaagccaataactttgactatgctaaaataatgtttctcaaatcctcttaaattacttcaaagaagaaaaaatttaccaattctcccttggattattttttttaacaacttttggttaaacatatacaaaaataaaattaacttgttcatgagttctaattccattatgggacataaacacacttataaattcattttctctgaaacaacaaaaccagtaaaattcaaactctctgctgcttcccatctacaataaatgatactgctttgctgaaactaaattatcactcacgattagtactggctgatacagtgcctttgtttaagttggacatttctatactgaactggagacaggtaatacttctattctccttttttctctgtttcaatgattttcaaagtctatttatacagtgtaccacaatgttatttgggctacacttgtatgaatacatcctttatgtattaaatccacctctccttttttattagctctcaacacttaaataattctccatggatatcaaaactgtatcctaagatacaatcccaaagaaaaatactgaaataatgtagagttgctcagttataatttgctcatataaccaatggatacttatttattttggattatcttcccaatctaaaaaaagaatacatataaaacactctcagaccctaaaaatatttatcagtaattaaacaagaatgcaggacccccatttaagaaatactgttttgatatatatatcaaatacttaataatagagtaaataagataattttaggttttaaggttactaaatgtagtaacaagcatgaattatttctgaatgtttgtaaatattatgaacaaaacctttcatattaattttctattctgtcaaaaaaaattctgttaagcatccaatctgagtaaagctcaataagagaagcttcaagagttgtgcattgcaacactattcacaatagcaaagacatagaatcaacctaaatgcccatcaatgatagattggataaagaaaatgtggtacatatacactgtggaatactatgcagccataataaagaacaagatcatgtattttgccagggcatggatggaaccattattcttagcaactaacacaggaacagaaaaccaaatattgcatgttctcaattataagtgggagctaaatgatgagaacacatggacacatcaacatcaaggggaacaacacacactggggcctattggaaggtggaggattggaagagggagaggatcaggaaaaataactaatgggcactaggcttaatacctgggtgataaaataatctgtacaacaagcccccatgacacaagtttatctctgtaacaaagctgcacatgtacccctgaacttaaaagttagaattgtgacaatgacagaagagagtccctgacttgggaaaccttatatagtgtgggagataagccatgtgaaccagcacaattccatgtgagatgtactaaatgccataggaagacactacagtttgcatacgtgctaatagaaagatgcaggaatgatccagaagacacaaaggtcatatatatatatatatatatatatatatatatatatatatatatatatatatctcccaatttctgccatgattgttccacctctttattacactcaatttttccataaatcactggggtgctagaagaagctacctcactctactgatttttaaatattttaattgcattaaaaattaatatatgtaagcggcaattctcaaaacctaaaataattctttttgtaacattattaaacaatttagacgtctaagcatgatctttacagctaatttaattttctgtagccctttttgtatactctttcccatttaaaaaaacatcactttaggagcccagcctttcagagaatgttcagagaaaccccacccagcagcctggctttatgaaaacaaacagcctttccttctctactgccctcttcactgagtagcatagcagataatcctcctcataatgctttggtgactgttaatgttatttatttaactgctgtaactgtgaaaaattctattccaacactaaaacaaatatgctaataagatagtattatctcttagaaataaaatagtcatcttctaaaggtaaactatcacaatatctaacatggtctatgagatatataggtaggtaggcaggcagataggtaggtagatagatgatagattagatagatagatagatagacagacagacagacagacagacagacagacagacagatagatgttgctcaattgtggctcatcacttgttgcatagcttccagctataatcaggaatggaattacaatgatgtattttagatagacatatagctgagcaggtctgatagtgagtatgtttccttcattcataccactaaaagagttgatatatttctgttagtcattcactcacgactgttagaaagttttgtgattatgtgtttgttatttcttccattgttctgcttaggagaaagaatattataatagtcaggaatgctaaaaactagttatttggtatctcacagaccaatcattttaattttgagccctccttttaaaaaaaatgaaactaagatgatttgatgtcatatggctttaaagatctttaaaatatcaactctctagaaaaatactagttctttagaaagagaccatctgacatatcattgccatgtatttcattaaaacttcatctttccagattccttataatttatcttattttcactgatcctggataatgctatttaaccataaatagattttcagattttaaataatggtatttctgcaaatcaagcacacaagcttatataaattatatttttagaatagtataaggaaactataaaacaaatttaagttaaattcaaaatgaaccctctcttctatccttgaatttgttttactaggtataaagaaattaaattgtttctatttttgtaaacagcttttacaaaataaagtaccaattaccttcacattggaggttaggagttcaacatatgactttgggggcaggggatacaaacactcattctataacagagatgtcatagacttcagagttgaaaataaatttctgttgttgaagccaaaaaaatgttcaaatactatgtaagtattttttctcagttctgtgctcattttgcttgcttagcttagctcctagaataccaacttcttttcttcttcttttttgtatatatgtgtttatgttttctctgcaattaaaaaattatgttgtactttttagggggaagaaaatgaaattataatccactatactgtttggttacttttcctctttgctttctcagacttctcatcgttatattttattttgttactgtttattacagaggaggtgtctgcaaggatagttcaagtagtcactgctgaggctgtagcagtcctgaaaggtgaacaagagaaagaagctcaacataaagaccagactgcagctctgcctttaggtaaataagaagattctcaggtcagggactgtgtctgttgcaccctgatcacaggataaagtcttcatgttcaaaagataggccatatcttgtacttcatccttacatgtaacattcatcagacaccttgactgggtatgcactaggacctattttcatctttttccactggtttgttgtagtgtttgcatagtctttcgttagggtggtgagcttacagttagacttttccctaagtggcccttaattttttcattttccagaccactagaaatagttattattaaaataaagccaatgccttatttcatgacctccacccataaggataatatactaaaactttcataagagatgattatttccctttacaggttttggtgaatgattatactgtagccttgtttgggtcttcctgaaatgactacacaaaacctatagccagagctttgttataatcgtgagtgactttgtatcttatatgaagtactgaacttcacttggttcatctaagggcgctgagagagtgctgctctctcccttagtaacaagacaaatgccctccatgccaagcaagtcatttaacgcatgcttgccaaaggaaacactctcagccaaagccttgctgcccctactcatagatagatagatagatagatagatagatagatagatagataggcagatagatagatagagagatggatgtatataggcagatagatagatagagagatggatgtatatacacaaagagatacaggaaaggagactctcttaaattcaatatatatatttatttcacaggtatatacacgtgagtcatagaaaggtgtgtttttaaaggcctaaaaaagtacatatccatttccctctcttacagtctaatatatccatgatatttgattttttgatcagtattcctttaactgtctattaaaaagtaagtaataaaaataatctgccctcccagaataataatttagaatacactcagtattttcagtactgtgggtttttttaattattaaggactatttttctcttaaaacacatagagaattatctaatctaaaacattaaccttcagtttattgttcacttttattccttgaaagaaaagaaaactcaattttttaaaacttgaaatcttaaaatacgccatgcagaagcccatagggtaaggaactaaaaaagtcacctgtcatcccaaatctgcctctaataactactttatgaagctgaaattcccctaatatttaaaatagatttaaccactggccttaaatgagaaatatttccttttgaaatttcttactgtcatatgagggggatcacaaatcatgtaagtgtcttgaaaaataaaacttaacattaactgtaaatgaattacatcttttagaacctttttctctggttccttttcatgtgtattgattgctaagaccagaagtttactcagcatatggtttttgtctgaaagttcactcaggctatgaaagcttatttttccatttctgagaatacatacagaagatgggttttgaaattagactcagtgaacaaaaggttgtttaaaaaatatattccctaaaataactattagtgatcaagataacacatgtttccagattgagcagttgaacaatagagagttctaatagttttttcagtcagtagctgaatccagactaaaaacacctgcctgcctgtgtgtgttttcatatggtaaattagggccaaaatgaaatattttattaattgaacaggtagacacattaatgagattaatgatggaattttagcaggcatctctaatctgtttttctagagatgataaaatcatttttttttgaaaatatcaaatgcttgtcttattttttaggttttcaaaaatgcatgaatcaggtaatgggcctataaataaaccaaatgcggcttactattgaatctttttctgaattttatagagaggtctttttacaaatggcagaacttcctacacatctaccagcctaaaaggattaattattgcatctcatttttctattgtttgatctttagcagctgaagaaacagctaatctgcctccttctccacccccatcacctgcctcagaacagactgtcacagtggaggaaggtaaggcctattggacttttcagggtttgtcttctgttaaagtgtgaacaataaacttcaatcaataagctctggactttggtattggttagtatgtgaccaagctttggagctatctgtttcaaataatgaagaagaaacaaagactttaaataaataatcacttatttttataaaagcaaaagtagaggaatttggtaaataaaaaagaaatctgcttgattaaggaaaagaattttgtgttcagttgctaaaataactgtagagaccccattcactttagaatgctttaacagggaagatacaattctaccttgtaagtgactgaacaaaaattaaaataaatataaatgtaatctccataatagtaggggtcagatttatcaatgaaatcaacacttccttatgaaagtgtcaggaattatctctgttttgctcactgttatattgccaagaccttccccagggcctgactcatagcaaatttaataaatattaatgaataaatgaagaagttaatgaatgaatctgatattgagagcattgaactggaagctgagctcatgactctttcctgttgagacctgttattgtccatggatctttttatgaacttactcaacatggaatgtcatgttagcttttcaattctcattgatacaacagaaagatgcctttgaagaattttcattcagaatctgagatgaaaggcactacttaaaaggaaaccattactggttctccgacttagtccagttaacctttgtttattgtttgagagtcacaggaaaaggcagagaagaactagggctccattgttgtttcaacattacttagttttcatatattaaaaccagaattttaaaagtgtttattttattcatttattcatttatttttcctttttactgtgttaaagactgaagaacatttattttaaaagacttgtctttttatcatttgtaattaggttcatttaaaatattctttgatttcgtaaatacaaaaatttgaattagtgaaccatatattatcacctctaatataattttattttgtcacagatttataaacctaaatttattttagcaaggtttttctttcttaaattgaagctttttttttccaatttactgcctgaaataataaacaaactaaatttttctgaggaataaaagaaactttggggataataatcagtgcatagcagccactgattattagttaatgtgatttaatcttttaatttataggtttgaaaagttccttttgaccttatgtttatccattcactgggcacatatttattgagccctacagtcttccaggtactcttcaaattctgagtatatactagtgaacaaaacagacatgatccctgcttttaaagagtacactatagccggtaatcccagcactttgggaggccgaggcgggcagatcacttgaggtcaggagttcaagatcagcctggccaacatggtgaaaacccgtctctactaaaaatacaaaaattagccaggcatggtggcgtacgcctataatcccagctactcgggaggctgaggcaggagaatcacttgaacccagaaggcggaggttgcagcgagccaagatggcaccattacactgtagcctggtgacatagcgagactccatctcaaaataaataaataaatagtacactatctagtggagaacagaaatccaataaataagcttaccaataatttcaaattggattagcattgaagaggaaaagaatagggagctttaaaatattacaagagaaacctgattttattgggtggtgaggggatggctaagtagctgagaccagaagcatgaggaggaagtgttggccaaataaagatagaaaaaagcacaagggcgctcaggtgcccaagaagatgaagtgacccaggaactgaagggggtccgtggctgatgggtagtgagaaagggtagagcagtggagtgtgagagtaagcagtggtcagctggggtcagtggcctagatttcattctgaatgcagcgggaagcctgacatgacccttgtacctccttcaggccatggaaaatgtttctaagctcctacttaaagcttttcaagcatcagagaatcctcttaacccagagagggatatgatgttgacagagcaggtttactccaaaagtcggcttgaggtcaagtcatttaatcttcttactctatatgggatttggaacagaaagggaagaagcagagtcctcccatccatctgggaattcacccagcctgcttcctgtagggtaatatgatggatataatgaaaacataaataaataaaatgtagaatcaccttcacattttggtaacttaggtgtcaactttccagagttccctaatattttggaattactttcttcaagctgtttcaagatattcaaggaaaataccacctaacctcttattgaaagtaattcaaagttattttcaagccaaacttgtgtttttaactttttgagtattgaactatctgaagttctgattatttgattttaaaagtataaccattttttgagttttaagaaaaacagatgtatatattttataaactctatctctataaagaccagataatattctcaccttaaatatgtaaaagatttgtggtctagacaaactactgtttctcttttatgttaagccacacttaagtaatatacaagtattttttaagtttagttttgtcagaaaataaattagtgacaagtcacaagacaggattgaactgttcaatttttcaaaccaagtagtttgtaaatactcagcccaaattccatcaatatattgcttatagcaggtcaggtggaaagggagcaggtggatttttttgccttatctaggggattatttaccctccttgataccctcaaagcaactttaatctgagggtatagtgactgctgcagtctgatccttttatacaaatggaagaaagctcttttgttagattaattcagcgattttgaggatacattttctttttgttaattatcaaactttttaaagctgttctttcccaaaggggaagcatgaaagcttccactaaaaatttaagatgttaattactataatttatgaatatttattataattaatgtaatattagtaattcccaggatatgtgcttattctagaaaacatttacaagggattttgatgaaaaaaaaggaaacaagctgcacacttagaaaaggatctacggtacagtaaaccaaacctgtactgattatgatgttttcaaattaacctcctttttctttttggcctaatcataatagttgtcatttggactgagctattagaatttggaaggctgtgaaggaatggaataatctgaacacagaaccaggattctttctgcccttttaggtttgctccagaattctagggtggtgttttcctgtgtcatggatgtggtgacctaatcatcgcgcatctgaaagtagttttctctttatgtcattctggggcagcagtaacagtcagcagactgagaagtcctcagtcaaaagctggcagaatggaaagggcttggaaatggtggagaacaatgtaagtgcggccagcagccatcgaccatatgctgtgatgccacaacaagcaaaaagtaccgaatcactaacattccacaagatgcagtctccaaaggaggctggtatactaaggctgggttttacatggcaaaccttacattagcccagtgtaaattttcaaatgctttatttaaaagaaaaagtttcaatgaaagcaaactagggaaactttattcctccattgaaaccaggtaagctttatttttgaagattataattatgcagaaaactatgcaaaagtccaaggtgtataaggttaccctgtttttagcataacacgtgattaaatgaaatagaatattctgtggcaaaagcagagtccccagaagcatgcccacttctagtaaaaggatgcatgcattcaatcctgacctcaaacagcaaactaactgttgtgaaataaatttaatttttaatatatctctcaactccaactttgatgtgctaaatgaggggaaagaacagaggtacctgacaacttgtctgagtacactgaagacacagatgctaagatgtatggagtcagacattgtgcttggcattttcacagatatcttctcatttaatcctcccagcaacccacagagatagataatattcatttccactcctttgcccaaaatgttatggtttatgtctggagaagtggcttatccagaatgcaaatccaaatctaaattctgcaatcacggttgcactacatccctaaagctgtttcttatcaaggttcttactgtgagactatggaagtaaattatcttcaaatgagagttatttgttacaagctactatactaatttcctttaagaaaaaaaatcttacaaataaatattccatttattatttatttatttaaaattattatgtcttccatctgcattgggagtgatccagatgcacctgccatacacaacacaataagaaatgagaatctaatgtcttctgtcattatcattaaaatcaagtgccctgtttggcttagccctccctggtccccataaagcatagcttccctggcatatctctagagcttgtaacgtagatggactttaggctgataggtcttaaacagagacttggagtacagacagcttacagtaccaagagaagattggactttgccagacactctttttgaagttgccttggtcccaggccagatgaatactaaaaagaagctactttttccactagatctttcaaaatttgtgttgttctttttgttgtttcctgattagagtgaaagttttcagaatagaaaataccatttaccatttttttaaatgctatagatctgaagcaaggctctggactgtttttaaatgttggcactttcacaaagaacaatgacaacaagaaagaggtggccagaatctgcaaaaggttaaaacatccaatgagtattgcctttactctcagcttgaaattctttaattttatactatagtctgctgtacctcccagaaaataaatgttgaaaagcagagaggagcatatcccattttcatttattgatcatgaaagtaccctactgaacatatcaggaattttagaagtaacttgcatacatggggaatttacagccccagagatccactgagagaaatatgaatggctaggacatgtgacaagccagggctatgattcagtcagtgttgtaggccagatcttggacaattatctgctcagctgcgaaatcgtgccgagttgaactaagaatatcaaacgttattttaggcttctgctatcccatgatataaaaagcattgtggctgagaaagttctgagcatccatccagaaacatcttccatggaacaatcagtaaataatgtgcttgaaagattaaatgtattctctctacaaaatgttattttagtatcctcatgatttcagacttatttctagttgtcagcacttggttgccaaaaataagttactgtcctaaaaatacagtatatttgcaaattaatgctataattttgtcttcttaaaatctgatataaataaaaactgtacagatagatactatagattttgttcttattattgagagtcatgaaattttaaattgatatctcaatataagtaaataaatagtgattagcaaatttagcaaccaccacataggcctgagatgtaacgtctgcaccacatcagaagccaagtgctcactgagttatacgagaatccaaatgctaagcagactgatctacagttgtatatttaaggagatatgtttaaataatgcaaatttcctaggcaagatacaggaaagaacagaaatgagagtagttactttagcatttcaataagaaatatgcaataagaggtttgaaacatgaaaaacagccaagagccagtggtacaaatgaaactacatggaataaagtcttgatgaatctgcagccgactctgcagaaatttttagctaattgtatctctgctaagctttcagaaggaaaacaaaacataagaaaacaagtttataatattagaggctttcttaaaacagtatacttttagtgtcctgcaaatcagaacctggtttaaaatgatgcctctaggtactacattagccttagcatccaaagaaagagctatgctgactgcgcatttcttattaaggcaggaaagaggcataatgcattgtagatttttcttaacaggattgaaattaaaaatgactttctggttaaagttattaactagaattaaattaaccaaaacactacttgtgcatcctagataattaagactatgttttaaacaggactgttttcttcataatcttacaggcgttaaatcctaataactttcttctttttaaacttataaacatattgatctaagcatgagtagagttaaccttcatgaaataatttcctccaaagaatgcatttgttttgtaatgctttgtttctattccaacgttccttggttattctgacttgtttgagaggaatgtacagatgatttttattttgccgcagggctgtcaatgcttttggttcacttagatcaatggcaaacttgcttaagggataggtggaattcagcagttactgaggcatgaaacattcactgtctcccatcctccatcagcttgatcttgctaatttcccttcatcctgctgtgctgcttctgtggcccttcctgcccttgtgtaggtgtttgtttcgtccgtctgatcttgtgtctgtgttgtccagttctccctgcagtttcttcctgtgtgtctgtttgtagatgaaggggctgaggatcaagtgggtcctctacacaggttccccagccatgaacctgccaccagcggggagaggcgtggactcctagccccctccatctcagtgtctgtgcctgatgatgacccttacaattccgatgaggagtactatgagcatcctttgttcagctcagaacggaccacctctagtgtgctccccagtgtcacagcgcagagtgcagaggcccacttaggccaggagaaaggtgaaccaagcatggtccccttttgctcctccgccccggcctacagctttgaccacctacatcatgttaagtgtgccttaatacagggtgggaggggcaggagcctgttttctctgcatgaaagtgaagttcctatataagttgaatctatccaaatgccttaacaatttatataaaagaagccttactagaggcatgtgagcacttcctttttctgtatcattgcttctgagaaggaagaaaaagagagagagaaagagagagagaagcaaaaaaatattccattaaagtatggcttctttctgctccctgccaataatcagctggggaagaacatattctttacccaaaccaaagaagatgactctgaatataatttttttcctccttagacacataatattactattaaatagcatctttaaatagcatctttaaatagcattagctttctttttagtgctatattaatatgatagatctttaaaagagaaagaatgaagaatctgtttagagcagaataaatgttatggaaacaatttatttccccatatcatgtaatcatctacagaaactacagaggcttccccaggtgactaaatcttggctcacatcagtagagctggactaaaatgaaggaaatgattcaaagcctttgtcattctagccttataaagctgggagactcaagtgtataattggttatcgtgaggataaaataagtaggtgatgggctgcaatgtgtctcattctaactaggtagttttggtaaagaaaaaaaaggtacagctaaatatatttttgcttaggcgaagagtttatttccaaaagggacaatatttaatatgaaagcagatagttctaaagcaataaggaataagcttacagctcaccaactatggtcatcataataaacgtcttcaaggacccttttgaaaacagaacaccaatagctcaggttctctgataaagaaatataacccctattaagtgaaactaagttcttctaaactaaatttctaaaatatgtgagtttttaaattaggaacaattgtagtggaaataaatatgatttatactaaatgagaaaatgaaaagctaaaaagctacatggatttgaaaacatgtaaattaacttgattagactttatccaaaaaggtaacattataatgcagttatattaaaattcttttaactgtaatcaaaatctatggcattataaaaattttcttaaaataacaagttagaatttaaatttttaaaatgctacttaaaatgccataattaaattacaaaactaaaaatgagtgctaaatgtgaagagattgataatgtagatttttttttctctctctgtttctctctgaggatattaatatttctaaaaaacaaaataaaagaaaattccttttctttttatctgtagtctttccctcagggccgtttaaacaatgcacaattatttcataagaattttgtaagaatcttccatttacaaaactataaaacagctcatatatttctctctaattccttaagtgaccaaatggaatttacttatttttactgacatttcaagtgtaaatgagaaacaaattagtgcaataactcatgaacttgaaaagtttatctttacatcttaaatgttaacttttttatgtgatatacatggtttggggggtggttattttggccgtttgattgccactcaattatctttccttggtgattttgttttgaattacagaaataagactttattactaatgtgcatattttttctttagtgtcaaagagaattatacatgaactacattactgatatttcagggagtttaacaatatgataatagttgtgtcccagaggtagacttttgtaaacagatttaaatttaaccttgaccttgtttttaacacattttattttacttactttttgaaaatgttcattttctccaacatcatacaatgcaatgaagctaacataacttgacttaggtagtcccttaccttggaaatgctaaataaattatattttaagtaaatttggtggactttgtgataaagctgttaaggtagttggttggatattcttttgaagcaaggctttttttattcccaaagatttctttagcaaaatttgcacattttaaataaagcagccgggaattcttatgtaggggcttcctgcattggcgaaaacagcacatgtctaacaaatttaaaggcttttttttttcagtacatcagtacatccatcttttcacaaccatctgttatccggcagtaccatctcttatttccagcaagctttccacatgcgtgcaacttactgccgtttccaataagggtaatcaatcaatacaaccctttcagctctcaaactttaaaataaattgccttttaatgagactttaaaagtcatcactattagcagattatacatcatagttttccaaccagtacctaatgtatgttgcattagaatattaatttgttcatcccaatggtaaaataaaaaaacagctgaggtcttcatgaggtcattctaatggagctgaaagtgttcctttagcaatatttctgtcgtttcatgtattgttctgtggtcatgatgtcaacatctttttcatccctaagaagaagaaacgctagagagtcggatggctgaggaagagaaacctgctgctcttcctgagaaagagtgtggggctgctaagtcctcagaccaacccaagggcctcagtaagggccaaatggagtctagtgcggaggcccaaatagttcccgaagagagtgccccagcaggggccccacatgagaaaagtgtaaaagaggtcaaggaggtgtctccagaagtaaaaaccccttcctctgctggggaaggtgtgtctttctcaggatttgcatgtgttttgttgcaaatgatctctccagtggcttaccaacctgatgcctttccaacgctatttcgctatttcatcgctgggtcttatgataacaagtccactgttgtaggcttaatgtgcagagagtgtggcttgcgcaagtgctgtgtggcagctggttttccagtgctgcagctgattcctggttttcctttgccatgatacaatacgctttgcagccaggctgatgatgctatgtgagcttctttttttattttatttttttacccgccccccctcatctcaaatgtttgccagtcacattgctaatacatgtatatttttgtttttattttggggacagcaattcatatgcttttatttcaaatcgtacagttggattttggcacatagaggcttaaatggtggaatcgtttttgtttgcaaccgaaatgtgctatattttttatgcttcaatgaatactggtttgattttcttgacctcctgctgatgcttctcatatcattttctccccatggcagccagcccttctgatcatccccatatctcttgagttttcattcatctaacctttattagaagttcatcaagtatttttttttctattgttacaacaggacacataagtatataaggtaatgatgatccatacacttgctcttttagagatgattgaattttattatttttccccaaatcttttccagataactacatttagctctaatgaccacagtgaactactttgaccttaaaacacaagtgggacaataaagccttttggattgttgaataaataaaagtaaaaatgtgttatctaatttctgtgaagcacctctaaagccaatactggccaatgcttcaccagttagtcatgctccaaggattgaggtcatgaccatgggaataaagttatttcaatagttgactcttttgaaaagtttgttactcacatgacttcccagtatcaacagtgtaattcagattttcttatatctaccgtacagactaagtaatgattaggaatttaaatttttaaatatgtaatagaaactggcttgtaaattcttaagtcatatcatataaaattgatagcaaatatttacttatatttctgaaatttatcctcagatgaattctaaaaatttatgccagtaacctgtggatgcctaaagaattggccctgacatttgttaatcaagttaactgcaactattaacattatatcattgtgcattacttggccctctgcccatagcctaccaattcatttttaaatgataaaaccaatgaaaatgttcagtataaatcaattctttatctatatttagtccttactatatattcttttgtaccctaacattagctgcttactcaatattcattagcttataacttttatgtatagaaggcacatgaatttgtttcttctgtaatacacatcacataatgtttaggagagaccaaaaaaaaaaaaaacaaagaaaaaaagagaaaagaatatccagaaatatactgttcttacaattcctttgcacattaatttacaaccagagttcattttagtaatagtacacatatatctcagtcctgaccttttcatattgacttttacatgggtagcatgcttgcatgttccataatttttgtttttattctaccattcatttatcacttcaaaatataattttaagcttatttcctgaacgcacttgcctattatttgtttaaaaatcaacccgattacttcagatttacttacagcctcgaagatggagttccacgatcaacaggaattgactccctctacagctgagccttcagaccagaaggaaaaggagtcagagaagcaaagtaagcctggtgaagaccttaaacatgctgccttagtttctcagccagagacaactaaaacttaccctgataaaaaggacatgcaaggcacggaagaagaaaaagcacccctagctttgtttgggcacactcttgttgccagcctggaagacatgaaacagaagacagaaccaagccttgtagtacctggcattgacctccctaaagagcctccaactccaaaagaacaaaaggactggttcatcgaaatgccaacggaagcaaaaaaggatgagtggggtttagttgcccccatatctcctggccctctgactcccatgagggaaaaagatgtatttgatgatatcccaaaatgggaagggaaacagtttgattctcccatgccaagtccctttcaagggggaagcttcactcttcctttagatgtcatgaagaatgaaatagttacagaaacatcgccctttgcccctgcctttttacagccagatgacaaaaaatctctgcaacaaaccagtggcccagctactgccaaagatagttttaaaattgaagagccccatgaggctaaacctgacaaaatggcagaagcaccaccctcagaggcaatgaccttacccaaagatgctcacattccagttgtagaagaacatgttatggggaaagttttagaggaagaaaaggaggccataaatcaagagactgtgcagcaaagggatactttcacccccagtggacaggaacctatacttactgaaaaggaaactgagctgaagcttgaagaaaaaaccaccatttctgacaaagaagctgtgccaaaagagagtaaacccccaaaacctgcagatgaagaaataggcataattcagacctccacagagcacactttctcagaacagaaagaccaagagcctaccacagatatgttgaaacaggactcgttccctgtaagtttggagcaagcagttacagattcagccatgacctctaaaacactggagaaagccatgaccgaaccatctgcattaattgaaaagagctcaattcaggaactttttgaaatgagagttgatgacaaagataagattgaaggagttggagctgcaacatcagctgagcttgatatgccattttatgaagataaatcaggaatgtccaagtactttgaaacatctgccttgaaagaagaagcaacaaaaagcattgagccaggcagtgattactatgaactgagtgacactagagaaagtgtccatgagtctattgataccatgtctcccatgcataaaaatggtgacaaggagtttcaaacaggaaaagaatcccagcccagtcctccagcacaagaagcagggtacagcactctcgcacagagttatccatcagatttacctgaagaacccagttctcctcaagaaagaatgttcactattgatccaaaagtgtatggagagaaaagggacctccacagtaagaataaggatgatttgacccttagcaggagtttaggacttggtggtaggtctgcaatagaacaaagaagcatgtcaatcaatttgccgatgtcttgcctagattccatagcccttggatttaactttggtcggggacatgatctttctcctctggcttccgatattctaaccaacactagtggaagtatggatgaaggggatgattaccttccagccaccacacctgcactggagaaagccccttgcttccctgtagaaagcaaagaggaagaacagatagagaaagtaaaagctactggagaagaaagtactcaagcggagatatcatgtgagtctcctttcctagccaaagatttttacaaaaatggtactgtcatggcacctgaccttcctgaaatgctagatctggcaggcacaaggtcaagattggcttctgtgagtgcagatgctgaggttgccaggaggaaatcagtcccatcagagactgtggttgaggatagtcgtactggcttgcccccggtaactgatgaaaaccatgtcattgtaaaaacggacagtcagctcgaagacctgggctactgtgtgttcaataagtacacagtcccattgccatcacctgttcaagacagtgagaatttatcaggggagagtggtaccttttacgaaggcactgatgataaagttcgaagagatttggccacagacctttcactgattgaagtgaaactggcagcagccggaagagtcaaagatgagttcagtgttgacaaagaagcatccgcgcatatctctggtgacaaatcaggactgagtaaggagtttgaccaagagaagaaagctaatgataggttggatactgtactagaaaagagtgaagaacatgctgattcaaaagaacatgccaagaaaactgaagaggctggtgatgaaatagaaacattcggattaggagtaacctatgagcaagctttggccaaagatttgtcaataccaacagatgcatcctctgagaaagcagagaagggtcttagttcagtgccagagatagctgaggtagaaccatccaaaaaggtggaacaaggtctggattttgctgtccagggtcaactagatgttaaaattagtgactttggacagatggcttcagggctaaacatagatgatagaagggcaacagagctaaaacttgaggctacacaggacatgaccccctcatccaaagcaccgcaggaggcagatgcatttatgggtgttgagtctggccacatgaaagaaggcactaaagttagtgagacagaagtcaaagagaaggtggccaagcctgacttggtgcaccaggaggctgtagacaaggaggagtcctatgaatctagtggtgagcatgaaagtctcaccatggagtccttgaaagctgatgagggcaagaaggaaacatctccagaatcatctctaattcaagatgagattgccgtcaaattgtcagtggaaataccttgcccacctgctgtttcagaggctgatttagccacagatgagagagctgatgtccagatggaatttattcaggggccaaaagaagaaagcaaagagaccccagatatatccatcacgccttctgatgttgcagagccattgcatgaaacgatcgtatctgaaccagcagagattcagagtgaggaagaagagatagaagcccagggagaatatgataaactgctcttccgctcagacacccttcagataactgacctgggtgtctcaggtgccagggaggaatttgtggagacctgcccaagtgaacacaaaggagtgattgagtctgttgtgaccatcgaggatgatttcatcactgtagtgcaaaccacaactgatgaaggggagtcagggtcccacagcgtgcgttttgcagccctagagcagcctgaggtggaaaggagaccatctcctcatgatgaagaagagtttgaagtagaagaggcagctgaagcccaggcagaacccaaagatggttccccagaggctccagcttcccctgagagagaagaggttgcactttctgaatataagacagaaacctatgacgattacaaagatgagaccaccattgacgactccatcatggacgctgacagcctctgggtggacactcaaggtgtgcattattattattattattttaactcaaacacaataaccttatgggaattttttttcacttaaacattttaaaatacctctttatctctttattttgtattttgttaaatatacaaaggattttgtacacttgttactaatgttttcactgttgttgttgttgtcatgatttgctttgatccacagatgatgataggagcatcatgacagaacagttagaaactattcctaaagaggagaaagctgaaaaggaagctcggagatcatctcttgagaaacatagaaaagaaaagccttttaaaaccgggagaggcagaatttccactcctgaaagaaaagtagctaaaaaggaacctagcacagtctccagagatgaagtgagaaggaaaaaaggttcatttaacaatcacttctttaaaaatgtttttgaagtaattcattattacttttttgcagaactgcctaacagtggtaactaattatttataaaatttcgttcggttttgctccacgtgtttattttttcctgatggtatgctttttgtgttttcttattcatagcagtttataagaaggctgaacttgctaaaaaaacagaagttcaggcccactctccctccaggaaattcattttaaaacctgctatcaaatatactagaccaactcatctctcctgtgttaagcggaaaaccacaggtgactgttcaattctgcaatgtgactggcaaacatagacatgtattttttttttaaatctcattactgtagcagcttcttcattttgtttttcttccaagaatctcagcagtcatgaacaattttgctattaagtgtcttgtatcattattcttttttcccccctccttacagaaaaggtcatgaccatctgtttctttgtcatgctcagacataacagtgcgtgattgtatcttggcattgtgctctagtgtcacgttctggggattcctattttcattctgtgtgtttggttagacgatggcgatgaatttaactgtggtatgcattctcattattttgcttatttatctctctcatgcttaaacccataaatatttgtcctattttctacattgttactgccaaatctgttactgatgttgatgaatttattgaaaaccaccaagaatgtgtagtgatttagatactgaaaatgaaaagcaagccaggaagtgaaattgtggtttgcaaaattactattactttgcttttgctgaaaaaaagaagatagaaaacaaaattttctggtaattatatcagattttattcctcatatccaaaattaacaagattttcactctactgaactacatctcttagctgacattttgtcatggagatttcttaaatatgttggatccaaactgctcgacttttctatataatttagtttcacaaatttgaagctaaaactcttccttttaggaggaacttcagttagaaataaacttcggtttatttttactttgctgtctactttttttttgtttcccaagacggaatctcgctctgtcgcccaggctggagtgcagtggcacgacctcggctcactgaaacctccacctcctgggttcaagcagttcttctgcctcagcctccggagtagctgggattacaggcgtgcacccagctaattttttttttttttgtatttttagtagagacggggtttcaccatcttggccaggctggttttgaactcctgacctcgtgatccacctgcctcagcctcccaaagtgctgggattacaggcatgagccactgcacccggcctgctatctacttattactcttcttcaaatacatattttttcctaagtttataaaactggtaaaacaaaggaatgaaacttgttggaaaccatcataaaaacccctacaaatatctgtaatgccaacttttttctaaatttcagggcaaagtatttattttatatgtttaattatactaggataatcttaccttacactatattttattttagcatttattaagtggcatgcttgtagtctacaaaatgacagattgctaaatcagaaaagaatgtttttctttccattgtacatcatcaatgcctctatataaatcttcggatggttttaaaggttaagaggaacattagcctttgtgagaaagagaaaatcaaggtaactgatggttttattttagccattgaaaattccaagtattttgtatttgtgttcttcatctagaaatcatatcatgtgctttccttcaaaaacaagaatctaaggcaggatttgaaaatagaaggcttgtatatacgcacaccttgataaagcttcaggatgaagaatatatctgaagctaggagttaggaattaacgtgacatacctcaattcattttctcaggtttttagcttcattaaacttagaacttcattaaacttaatagcaaattaatagcttcattaaacttagtagcaaaattgcttgggcaagcagaatctcttgatttagcataaaaactctataacctacctaaaaggatgaaagatgtcatcaggattgtggaattttagagaaaacgtaaaatggtttagtaaagtgtttacatgtcattggtattcaatttgccacatttaaagtaaattgtgtttttattcattctttgaaagaaatttaaaatctttgaactaatgaagattttcctttattctggtctaatgttaagatactttaggagaaagcatgtatcagatgtaggtgtcattggtttgaagcaagctatacatgtcacaagaatttgagttatattacagagatagtagtaaggcatcgttttcactgcttccttaaaaacaatgagtcctagaatctgaaaaatctcactagctagtcctacatggcataaagcatattgtagacagttattatgtttgtgtcagaactgtacctgtcataaaaatacctttttagaacttattcagagggcttataaggatacattttttttctgagggtttctattttatgaatgaaaattaaggaggaataaacacacaagcttgattattttatcttctaagcccaattttcaaacatagatggttttccaaaccacaagggattgttttaaatcatgagagctaagctacctcaggtaagtcatcaaccaaaatgtgctagagataatggagtttaaaattgaatccagaagcataaaacagcagcaagagaaacaacagtaacagatgtggtaataatttcatacaggaagtgcatgtgtagaacatgttctgtatttactgaacttaaattttctctcgtgttttctgttcttgacaagctatttttcttcccttctcatgtggcattttcacatcaaacaagtatgtcattcatattgtgaaatgaagggatacaaagggaaaggggttagctgatcatgacagtttgaaatgtaaaataccgaaatatctatggttatgccagtggcttccagaacaagaagagggtttggaaatctctatgaaccctcttctatatatcatgtgaaccccagaaaccaatcagtgttctttttcttaaattttgcaacattcacattgctattctgtaacttctgttctaaaggatctccttacgtactagtgattcaaagatacattggtaatcaatagaaaaattacgtggtgtgcttacctgcactttggtagacaatgggttatattaattagcacacactatttgttggagccacatgctatgttattgttattcatgttacttgagttattgaatttgagtctcataataagcaaacttttgctttgcattagtctgttgacacaacagaatatcctacaggtatttaaaactgcatttatgactttttagcaactaagtttggggttgtttgtcttttattttcaacagcagcaggtggggaatcagctctggctcccagtgtatttaaacaggcaaaggacaaagtctctgtgagtaaaataagtttttccttgttcttcatttgaagttcctttggtattagctgtaacatcagaataacttttgatattgtttagatatttactcttaaaagtcactttaaatagttcgctcacccagaagattctccgtggcatccaggcatggaaggatgaacgtcttctgggatggcgtatgatggtaattggtgagggcacagctggactgcttccttactagtaagacaaaaacatagaaagcagcacaatgatatggcaaaagtaaggaagtccagtttagttacttttcatagaatcaaattaaaccatataatcaacagtaactgtattttataatacactttcattgtttttgttacaaaatagaaatatgaccaaatgaagcactgcacacaagcagaaagaagtagaaatcaattataatcctcttatcataaagataaacacagctatcattttgatgtaaaatcctaatttttttctatacatttataggcttaacaacaaaaatgagaacactgtgtatcactttttaaattcaacagtaaatgtacttccatgtcgttgaacattttgtaagttttaatgactacgtaatactgcattttatttctttgcaatgatatacttaatcaatttcctattatttgacttttagaattttttgttggtattttaacaatattactgtagagaactttttggctaagttcagtttgtatgctatttccttcattttctactagtgaaattattgtttcaagaaaaatgttaatatttaaagtttttgctgcatattgtcaaattgccctctggaaaggttctacccacttatacattctgtataaggagagtgttcatatttgttattattactacatattttatattgttgttgtatatttgccaaattatagagatggcatatattattattttaaaattttattttggttgtattaatggtgtttaacttcttcatatgtttgtaaatcttttctattttttctgtgaattttatttttatattattaactgtattttaatgaccaaagccaacatgaagtattttcactcctttatgattgaaagaaaaaaattaaaaggctactaatgaaatcctaaaattataacaaataatttgaatgatattaattagtagcttataacaacattctgagactgagcaaacacatgtaatatgtaaatcacaattcttagcttacccttctaaaaaaccaataagattttagacttccacttttatttattatgaaaagtagtgagtgattcatttctttgatcttgaacctgaggggttttatgttgataaaagatgatacttgatttttatacaaatgtttcagatatattcctgaacatatggcaagcaacagaattcatttattgctttggtgaatattaggctttattataaacacattgtgatttcaagatttgtatctctttaccttctgtttccaaattaatgatgtatggtggttggccgtagggctatgaaacaaatcatgttcaaatcttgaacatctattagttatatgatccttttcttcctatttcttaattttctaaaaataaaggggaggacaaaattcctgtctcatgagttagttataaaaattaaatgtaatgatgttataaaacagtatgcagtataatgtttagaacatagcattcatttaataaatggtaatagttgttagttattattttagttaactgaatggtggaagttttcaggagcagatatagaaaataagtctgacctttcctcctttaggttgacattatttggaacatttttaggaaatttttaagccccttggtctttgagtaactcgatagaatcagcacttggaacagaaccataggcatcgtctgacacaaaacaaccttttttccttgtaaatgcccgtcttgtctttctgaagcaaaattagcccttcattctttctttttttctcatttattagtctttttttcttcctaatcccatatccttgttctataagttttctaaaaccccgagtaacttttatttgatttagctctaatgttcagtatatccatcagtactgttctctgattttttttggtagttgtatgctctttcagattcactttttttaacttaaaaattttttttctatgggtacatattagttgtatatatttatgggatgcctgtgatgattttttaaattgctctttattaggaaacagacccacccataatcctgcatttcacgtgggtttttctgttgtttgtttgtttagcattaatagttgtctttcttaactacaagcaatccaatttatttttctcttctatatcacgcttttgaaattcactcttttgtgggtaggatcaataaaaaaagaatgacttgtgctgacccaattacacttcccactcaagatactgggtctataaaacaagaagtgatttgtacagtctgtaaatacttatgtcctgttgtagccacagaggttaaaacttgagataaaaatctcagttttatctgtcatttctgtaacagttaaatcaaattaattatttgaagataataatctccttggctttgtcatacttatctatatttttaacagtcacccatgagacatatggcacgctggcatagctttctccaaaagccatacatccttcccaattatacttgcagacagtctccccaggagttatcaacacctgtaaattaagtcgtgatttttattggccatcttttcagtcctgactttcctttttagaattcataacacatcatgcagactctagtctttgcataaaaatgttattagttctatggtataacttaatccacagtatgtgtttcacttataaaatgaacaaattatatataaactctgaaaaattctgttgaagtcaatgtagatgacgtgaaaataaattttctcaatctttaaaaatacttttttcattattaggcttcaaatataccttgttccaaagttcttgaaacatgattaagatatggattatatgtacaccttaaaggctgtgtttattaaaggaataattccagcagataggatattgaaagatatttccaaatgtgttatcattataaaacttatgaattaattagagactatatacgtagaatccaaaaagaatattttatatacattatccttaaattagagaactatgtatagaatcattttttaaacaacaaaatttaagcactcagcattattttttaaacctgcaaaaagagagttttgctagtcacttgtaacattctttctatattaaggcttattgtatttttaaagagaaagagagacttgctttggtctcaggatttcacaaagctaattccttcatatctaagcaatattactctttcttctgtccttctatctatccacccactcatcatttattcagcaattatccgctggttctctactgcgtaccaaacataaacaatcacatttggaagtaaagaagagcaagtaataagtaataaacatggatacctgttctagacctggttaatagaaaataaaatggtttagcattatttttgtgttttatttgtataacagattttttattttatttttaatcagggtgtccatgtgcaggcttgttacaagggtatattacgtgatgctgaggtttgagcttatattgattccatcatccaaatagtgaacatagttcccaataggaacttcccaataggaagtttttcaatccttcccccacttttggagtcaccagtgtctattgttgccatctttatgtccgtgtgtacccattgtttagctcccacttataaatgagaacatgtgatatttggttttcttagacatttttctatgactattattaagttagttttggctaaaaagaactgtgaaaatctcttctcatctaagtacacatctctatcattgattataaccatttatcatgtgttcttattaaaaagactttgagtttcttatatgtttatacttcttttttatcttccttttactttatagtttggtttattttgtgcttttgtttgttttctttcatggctagaattctaccttgtcaaagattcctgctttacagggtagcacaaagtccccaagatacagctcagcctgccctagcacgactaaaagggctacattttctgacagtttattaatacagcccacctcagcaggctccacagaccgtttgccatactcaaaatcagggaacaaggtaaggcggcaggtcaataaaaggtgcagaaagaaatagaatttgggagaaggttatgttatagaacctaattcaggaaatgtatgaaagcaaatactttactctgaagtgtttgacacataaacagtaggcccttttaaaaacaaatacaaatttaaaattttgataaacagtatacctattttttaaatgtagaaaatatgtctttttctagatatgctacccattattaatttatggtttgattatctggtaaaatatcaaatgcaaactaacaaaacaaaatatattctattatatataatatataagaaataatattgtacagtacaataataacaaattacattgtatagaatataatagataatttaaactaaacgtcatatacatcagggtttaatactatctctgacacctaccaactcaattgtcttgaaacaattatataaactcattaaacttgtttcttcagctttaaaatgtgtatcatgttttgtggtgagaatcaaatcataaaaggatataaactataaagggttcctgtcacatacacgcacaagatatggtaatggtcattgttagaaatattatgcatgcagtgagctactctcagtcctttctgattaataaattatcatgctaatgaagatttttcaataaaattagtaatttgctgaagattgagtacatttattttaccaatattatcatttagaacttgaacttcacactcagttattagaactccaaaataatgtatttttacaaaacatctaggcaaatatgcactctttctaagttataaagtagaaatgtttataaatatatgaaatccagtagtttgtattaaaagaaattcatttattagcacaggaggaaaatagcaaaatcaatatcacttcgtataaattaaagagttacaagaacccaatgttctttttgttttctccaatcaggacggagtaaccaagagcccagaaaagcgctcttctctcccaagaccttcctccattctccctcctcggcgaggtgtgtcaggagacagagatgagaattccttctctctcaacagttctatctcttcttcagcacggcggaccaccagtaggtttattttgatttgaattcctttttaagcactttttaaatcctttaagtggaatagcacttatatttatattttaatttgtaaaaataaaacatgcattaagactagattatatttgccataaggatcagaaaatccagaatgtagatggctgcaaaatagctgtttgagtaaaaacaactgatggaggaaatggtaacatattaccctattatctaagactgatataaagttatttctctaagaatatatttttctttttgcttcaaatttagagcagaaaagaaaattctaaagaagtaatcaatgtagaaaccaagtcaaggattttaaaaacatacatctataaaagcttaacacttattagatttccaagttgtaaaatctaactagaaagtcgacattcaaaacttaggatcctgttcaacttcttaagaatttgcattccaaatgagctataaatatagcatagtctatgcaataggttcaaattatcttgattgatggcccattcatgaactgattggcaattgtaacagtttatataatgctccaatcattacacacttatatgttgcattgtggcaaactatctagtaaagcatggattcaaattacttccgtaaatatttttctgttgcaaccaaaatagctaccgtttattgagcacatatagatactaaactcttaagatacattttttcactaatttaattagcaagactaatgactattataataattaataaactcaattcattctactgatgagaaaactgaccctctagagagggtaacttgtccagttaccctctagagagggtaactgcttcacagttcgcaagtggttgaatttggttttcagcctactgataacttcacaacctgaagtcttaatgtcttttctacatttattgggaggaaatagtactagagaactgctctgtagaattatttggagaagagtatctgtgtcatttaagaaccattttaaaatggtggaaattgctaccactatcacattatagttgacttcaacacttattttgataataattggcccacttaaatatgactattggcatttaaacagtgtttttgcctacaagaaaagtgtttattataataacagtaattgtgtccaacattatttagtttcctagagtattagcatcctttgaaatatgtgttaagaacactgaaatcacaaaaactcttttatcatagcaaaaataaattatttgaatgaattagcaggaaggtcatttaagatttagtactctccagggaagagactttaaatctctagagttgaaattgaacataattaataaccccaaggatgtatgagacaagacaaagataccaagtactctcgaaaggaacatcttgaattatacttgtatttgttgctataaaagcaaaatggcactttctccataaatccacttcttcaaaccactgtgttctgccttttaaagtgtatctatatatgaattgattcattaaatgttcagcaccaattctattttgactttttaaatttactgatgtttacaggcattttgcattgtattatttgatagtgaacataactaacacattgataattttaaaacataggatctgttttacctctgcataccaatagctgaaaggcataaagacgattggaaaagcaagcactctgcccacttctacttgtgcaccatccccttaatggtacacagggatgttctaacattttgtgcagctattgaaaagatttgaaggaaacaatgttgtgcaggaagctcatccgcccaagaggaaggaaatccattgtcattgaggagttgacaagataaataaaagcacagtttaatcaattaacttgtaaagaaatatcttaaaagttgttttagatcttaggcttaacctcttcaagttcagaacaaataagaaacattcaaatttattgttttgatgacaagaacatatttattacaataaaaattggtcatatatattgaacagcagtgtgaaggccttaatatttgtagtttatcttctttctccagatgtaacataaaaccttcttttataaagcttaacgtgttttctacaagtatggaaatgactccttagaagtttagaaaaaattatttcatatagtaaaaattgttattcacatccagaatattgcttcaattcagtctccatgaagtcaaaaaacccctcagcacactttgatgaattctgaattattaaaaaaatatgttgtctacctactgttttcagctcacatgaaagtcaccagggctaggtacaatggcaaaaaatacagggatgatccctctccccagaatatctgagctattcaaaactggtgaagtaatagagaaaacattcaagaaagaaataatgtttctggagaaagtattcagacagacatagagacagacatctacgttacaaacttagtccataacaaaccaggacatggaagttacaaaatgccaagttggatgtggttgtgtcatcctagtcttgaaattcttgtgaaaagcaataaaaatcacagaacacatgctaatttctcactttagacttctcatatcccatttcatattatcaattgaagagtctaactatcttgtgccctgtgttagaagaccaaaaagacacagggcactttcatttgatacttgaaaactgttcactgaaagaagtaaaattcttctgtgtttctccaggagatagaacctatggtgatgggtggatttacattttccatagattacaattgtccaagaagctctcctgagctcacatcttgtaaatatttaagcaaagattacatgtccacttctcagaaagaacttcctatatttatgatcaattgcattaggtgacctctgagattcctttcacttcagtggctttaaaattgttatatatttattctctacaaaatttcagaagattcattgatttttttacttaagcagcagtaaaaaatgaaaattatcccttttctataaaatatgttataaatgaaatttgcatgcttaaaaatgtaaatcctcaggggctaaatattgtatctggcttagacgttagtagcatctgggtgaatgagcctcaatgttctcatttcttaggaataataagagctgcccctaacaactgtattgtgcatgtttgtttggttatcagttggttggtattcacataagtgctttgaaatttataaggtgttgcattcttatttctatcattctttcaggaaagtatttgaaatgtcattcaaagcacattcaaaagatgaaagaaacatagtataggaaagtggggggtgggaataataataatatgaggctgagctcaacttgaggcaaagaaatgcatctcagatcctgtataattaatgtggttttggatttaactctaaactgccaagctagtgatgaaaacagaggagaaaacacaatcaggtacgaggctcactgggaatatattgttgagacatcccaagtttctaaggcaagaaacagactttttttttggtttgaagcactgagataattttccttatgaaaagaatacatgatatagtatagcagtgtctgacagcttccataaacacatttacacctcatagtgttcctcagtataaggatataatattgaaatgcagatctttctatacaggccaaaactatgtgtcctaaatacatggttctatattgtatgttcacctggatcccagaatgaatttactacatagaggaatgaatgatctacatatcattcaaggaatcttcagtaaatatgggtctgcatacgacactaagtgtaaactctttccaactaaaggcagatccatttgccttaatagtcacacaagtagaaaatagtttttgacacattcataatgaaaattacggagaacaaatcagaaaaaaaaaatcaggtttttttctttgtgttgatagcaatgcatgttcaaaagaatgccaccgggttatgcacctgatttcagaaacgagactctcagcttcttgagtactatagtgataactgtttctaaataccttagaaattaaacgtattatgacttctaacaatctatgggaagagggatgttttgaggagaattgtctgactctggtttggttttggtcttgcttgttaatacagggtcagagccaattcgcagagcagggaagagtggtacctcaacacccactacccctgggtctactgccatcactcctggcaccccaccaagttattcttcacgcacaccaggcactcctggaacccctagctatcccaggacccctcacacaccaggaacccccaagtctgccatcttggtgccgagtgagaagaaggtcgccatcatacgtactcctccaaaatctcctgcgactcccaagcagcttcggcttattaaccaaccactgccagacctgaagaatgtcaaatccaaaatcggatcaacagacaacatcaaataccagcctaaaggggggcaggtaagaattgcatgaacacatatttgctgccagaaataattattacattgccttcttcatattgaaaactaacagttcttaaaagggaagcagaggtgttaaagagcttggttacaatttattgctaagagtttggactttacattaggaagatagcctctgaaatacaacgaaaatcacatgacatgcccattccttctgtttgttactgggtaaaaatttttaccaacttttagttgattgactaactttttttttttctgaatgtatctctattgctttgtgttttttaacttgagattaaagttatatttctgatataaaattgagttttctattttagtttctgaccatgagctcatttggctatcttttagtgattccaattttatctcctttcttccccaaggatttcctatgacattttctaccatttcctcatgtttactccaaaataaggatgtttcaccgagtttcaattctggctactattgcctaaatgttgcaaaggggaggtattcgtgttgataataaaagacacatggttctgatgaataaaattgtagactttgaacttctattcaagattaattgtattaaatagagctattagtaaagcttacttactaactcttaacttcagctccccagagcaaacattcatatcttttcaaaccagggggttttgagttctgtcttgacctgaaccttgcttatacactacatgtttggacaaagcaattagcctggaaggaaataatacaaatattatttaatgtttatctcataatattgatctattcaggatagtttaacttttgtcattgaagagatataaaacaacatccttttttgaaagaaagaaggacaaaaacagtaactttgtacataaacgaacttataatgccctttcagtattccaagaaagtctttcctttttaacgtcaatatttttttctgccactctttttcttgtctcttgtattttgtgccactgctttctggtatctctccttcatgccaaagaaaatctattttcaggaagaaagatcttgccaaaatgtaaagctatcaggcactcctactcaccaatgaagcaacaattcagtgttgctctttcatttagcaacaaacttctttgctgtctctttatggctctgtaagggaaagcccaaagagttaagaaaaatcaaccaatggggcaggaggggagaggtcaatatgcccttttagaacaatgataacattctataataatagagtcatagaaagatactttttcacagacagatgctatgaaaactagaagctacaagaaacatttttaagcaaaaagtagaattataagcctataattcctaaaaaactcaaactattcttgcgttcatcagagttttgcacatgcaagagaaggaaatattttgagctttttggaaatattcaaatgttgcatcatctttatatttatacataaataatttaaaagtgtaaggtgaataaaatcaatttagtaccatttggaaagttctgcattttagccttggacaagctatcctctaaaatagaataactattatgtatatttaaaaatcagttcttttaaaataaatattcccatgtcctgttattctcctcaactagatatggggtttacttaattatattctggaaaacattaatacttaaaataatttgtttcctcttagaatcacaagaaaatacaaattatctccaagatattgtattaaaactaacaaaagtaattaaaagagaaaagtattattttaagttgacatagaaattttataatatatgattttctttgaaggactccttaagaaaggcaaaaagaatggttttagccccagctttgcaggaacctctaagattcaatcaacccaaaaaatgtgaagacgtctgttttctttttctgattctttatcatatctggtttggagtatttttatgtcttattgtaattgacttctatatttggtaattcataaaattgatacaaaatatctcatacttttgagctgaactaaaacttccttagagattatggtggttaaggactagtaaatacatatgacacaaaaattacagaaagaacaaaaatagcttcaaaatcacagtgtcatttgaagcaaatatgtttttatcatcaggcaagtgttaacctgctacaaaattatcctacttcagcaatgatgactttggaaaaaatccacaacagtggagttatgaggtaacttttttgcagaagtaggaggtatttcctcaccaagataaacagatgaaagatatttgccttctattttgtgatagatggtataaattcacttaaagggtaaaatgaattgggaaataatagcgcattgcaattgaactgtctttgtaggaaaaacatatcattcaacacttcagcactctccccttaaaagcctccttacagtgtgtgatctcagatatagggagtgaggagaggttttttccatacttgtaaaactgaagatcttatagaacgactgaaggaaaagtattttagggcttcttagaaattatcaaaatgacatgttaaagacctttattagatgatcgagcatctatacatgcataccgttgaagaaattgaagccactagcacattgttctcaattgtaaattgattttcctaaggcacttgaatgggttggccaacgcagaaacatttaaaaagacagaacaagagctatactttcttcacgggccaggttttgtaatagtgatatatggtctctaggaattcagaaaaatattcatgtaattcttattaaagaagatgggagtaaaattaaagatgtaactttaattcctctgcacagggtctattgtggtaaaatttgaagcaattaggttgtatacaaatgatttaattgtgaaaacttcattattggggttttaaaatttgtgcaatctctaaaaattggtagaggaaatctataataaagatatatgcatcttaggaactcaacagctttccaaattatttgcctgcagtttgaacattaattgctcttctgtatgtacaggttttgtgcttaacagcagctatctcttctgttaaggtccaatttctgttggcagaggggctcagctcagtgagtcacatcaatgcctaatggaatagataagctagctgaagatacaaggagctttacagaaggcaataaagctaatcttttcagctaaaacaaattcattctattggaaagaatatgggcaatcatagattcagtgtagataattagcttgattgatttaactcaaggcatagggaagactatcttattaagtgtattaatttgaaactgctctatgtagctagcctctcaatctacattaaatctaagttttagaataaataatgttagcttttgaagaacacagctgcttcagttaaacaaaggtagagaaacaagcaatttctctaaacacgtagcataaaaaaatttaggtaacaactcaaggaatagtgctttttgccttttctatctaataatcaggttttaaaatagttacttggatttatatggaatgctcctatatgttttgacagatatcttgtttttctccattggctttatgaagatgagtataaaaagcacaagttggccaggtgtggtggctcatgcctgtaatcccagcactttgggaggccaaggcagcgggtggatcacctgaggtcaggagttcgagaccagcctggccaacatggtgaaaccccgtccctactaaaagtacaaaaaaaaaagaaaatagccaggcgtggtggtgggcaccagtaatcccagctacttgggaggctgaggcaggagaattgcttgaacccaggaggcagaggttgcagtgagccaagaccacgccattgcactccaacctgggcaacaagaatgaaactctgtctcaataaataaataaataaataaaattttaaaagcacaagttatatgcgcttgtaataattgaaagttactaaagaagtggtttcacagatgttgttttcattaactgctcattggataggatagtcagttagagcataatctctgcaaggccatgtctgtggatctgattgattgcctctgaattatgtgcttttgctccattaatgactacagtcagtcattttcaggttagctaggctacagatggtggcatcatcatgcaagtcactcctttttgaagaaaaaacagtactcactttttaaataaagaactttgtaaaatttgtcagcatattgctttcccaatcagcattggtctgtcatctttgtaaaatttttatttagataaatctattaaactagaacctgtaaaacatatcattacattctagaaataaagcaatcttagtttctatatctcagttctatatggatctattaaactaaaggatattagatgtcagagatatccatctccttctaatccaaccctcacattttcacagagtaagaaacagaagttctcacattacctgcatcttgcatataggacattaaatatcatccttccatggctgagctgtgaagtcagagtctatactttgtctttaatgaataattagtcacttatctgcaagtatgtaattttgtataccttagtcttctttgtttgccttacctttcatttcataacatgaaaataaatggtaattttatttagcagtgttttccatgccaaagttttttttaccacgtcaggattgaaatttgaagcttctaaacttttattatattttcatgaaataatttaatgcaaatagcatgttatattgatacactattaaaatacatgttatattaatatactacattaaatttggaaaggtatgttgcattttatcatattttttgttttctcctataattgacagttattttttaaataattctaaaaattaaggttttaaaatagaagctagttagctttttaatttctaaggataatataaagaatcaattatgaaatattatagcatcaatcttggcatcttaaaaataacatggggagttgtctcctattactttgataattccagaaatacaaagttttacctttctttacttgaccattgagtcaacaaatatttattgagcacctactacaccatgctatgttctacatactgaaatataacaacaaacaaaatagacatagatttcttaaattcttgccatcatggaatttacattctaggaggaaaggtgagcaaaaaaaaaagtgatataagaaaaatatgtaaaaaagtgctaagtatggagaaaaataaagataagaaagaggctcaggatatgttaagaggaaattgcatttctgataagatggctaggaaagtcccgagaaggtgatatttgaatagaagctccaaggaagtaaagaagtaagccatttggataactaggtaatgagcctttcaggcaaagggaaccacacatccaaagaccctgaggtagaagcaggcctaacatgttctaggaacagcaagtacatcagtgtgactgatgccacatacatctttgagtatagaaagtttatgctattattacattattatttttagtattattacatctattcaaataacaggactttcatattgctaaaccaaaaatctaagtgttgacttttcctctcactttctctcatcccatatcctaaccatctgattttgtgccctgaatagctcttaaatctggccatttcactcagtctgctctgcactaccttagcgcaggatacatgatctcttgctgatattgtcgcaattgttattaatttttggtttccctacatctgttgtttgctctatctgatgtactctctatactgtaaccaaactttctcaccacatttttcattaaatattccattatataattagtaatttaatgtctatcttgtttcacttactagaccataaggtccataaagtcagagatgaggtgcattttgtccataatgtcccatacatagtaggtgctcaataaatatgcagtgaaaattgaatgaatgtattatgccatattcatggagagatgcattcttttagtgacaccgttgaatgattatgaatgttttatgtcatgacagttattatccaaagaaactttccatgtttgtctaaaacaagcttgtccaacccatggcccttggggccacatgtggtgcaggatgactttgaatgtggcccaacacaaattcataaactttttaaaaacattttgagattttttgtgattttttttagctcatcagctatgattagttttagtgtattttatgtgtggctcaagaccattctttttcttccaatgtggcccagggaagccaaaagattggacaccctgatctaaaagaatattgaactaggatttaagagctgagttagtggtccagctcttctattaaagtattgcattaccttaggtactgattttttttttgtccttatttgtagaatggaagcaacaaaatcatgcttgtttttgtatatagcaccatttcatttaaatagactcttaaatcattttaaattctcacatgcatggtactacttggagcatgatagtagttatgcattacagttcatcaaaaaacattcatttaggtattctaatagattccatatatgtttgtgccacaagggccagctgaaattgagtaaaagagcaggtttctgaaatagaagaaaggtgtcataagggaagaaggagacatagagagggaggaagaagggaataaaattagtgaaatgtagggtggaatctttttaaatatattcttataaagttttaggcattatctgtattagtctgttctcacattgctataaagagctacccaagactgggaaatttatgaagaaaagaggtttaattgactcacagttccacaggcttaacagggcgcatgactgagaggcctgaggaaacttaaaatcatggcagaataggaactttcactctctctcctgccaccatgtgaagaaggtgcctgctttaagggaaagcagttccacacacttttaaatcatcagatctcatgagaactcaccgtcttgagaacagcaagggggaaatctgcccccatgttccaatctcctcccaccaggtccctcctccaattcaacctgagatttgggcagggacacaaatccaaatcatattgttaccctcggattatttgtaggccctttaaatgctaattacatagtttaccttcaattttatatttaagaaaatggattaattctggaagcaactaataaattatagtgaaacagaattttccctcattatatgaaattataatggttaccactatgaaggtctactgggtgctattaacatgtaagcatatttataacatataagatgaagagagaaagattgcaatgaatctttttctcattcacatatttattctttcatcaaacatttactaagattgctgggcattaaatgacaaaagggcaatgggagacaatgaggcatggtctctgcaatctaggcaaaaaggaggttttttgttttttgttttgtttcttgtcctcctctaatgtcttccccttatttaattttaagtttttttccaagccatttcttcacatcttcttagagctacaataagggctaaataagaggactcataaaataccctacgaacttgtaaaaatactgttggtcaacacagcatgaagaaatttattacaaggcttttgtttgttttgttttgttttttgatatcaaagtcatcattatatcagagtgaaagctacttaagatcaggactctgtctttatgcaatagaattttgtaactataaatcaaatgtcttttgtggagtaatgaaaaggttttgagctaggttgagtaaatactaatttttaaaaattatgagaaaattaccactttgggtttgcaaagttgaggcttgttgagcctttttatctactgttcattcacaagccaaacaaagacacaggaactaatgaggttattttcagataactgagcagactatttaacaattactttctttgatgacttcgtccactattccttagaatttcttaaaaatttaaacaagaaaaaatttaatgtcaaaaaattataatatacaaatttgaaaaagttcattagctgttcattttcatgaatcaaaatgactgttgtactcataatgtttcttccagcgcccactgagagaccatttacaaatacgtaaaaatgggtccagtgactgaactcattaatgtctattccactaaaacgttctttccaaattcttcagcattatctattcaccccgggcttttcagtgtggttctactttctgtgccatgcgactcagcttgcgtaggaaaattggtctctccaacttttcttttagagttttgtggaattgtgcattttgacataaactgttatttcttcctaaatgtgtatttaaatatacatattgtttatattggatataaaaaattttaaagaaactattgttcaatgtaggcagggatgattaaaattctgattataatgtctgcatacattttaaccagagtgcaaagtttttaacagatgaatctttgaagaacatcatgtgtgccagagaactttcaatcttcgggaatatctgatgtagtcatagtttgttttactataggatacttgaggattttatagaggcgaaatagttttccttaaaatgaatattatgaaataaaaaatactttcgaaagagagagaaagtattttcataatgcaagaacaaaggaaggcttaattttatgccatcttgagaaatgagggaaacccaaaggagaaacttaatcccctgcaaggttaaagggaagtcagttgagtgccactgttcactcccccttctcaaaagcattctttctgatacaactcagatggaggaagagagaaacggtgttgcaacctaggttcgtacctaatggatgcctgagggggtctagacaaatccaaattatttgactcctagtcaccctccacatctcaccacgttgagctgacgtgtgggtcttttgttaaagagagcagtgttagagtcaatttaaaaataaatcaaaatctcattgctcaagaaattcaagttgacattgggatgaatgcctccaacttacaaattgttttactaaaaattgtacattaagaatgtattttctttcattttacgtttcttagtaagagagatgtttttttcttgtctgcaggcatatcctgcattttctgtttcaatcctttcctagagcaaccctgttttaggggaacaggttaatttattgaaagaaacaattaaatatatgcagagagagagagcaccgtggcagatcacttcaattaaaccgtggtgataaaatccaactaaagtcacacaaggaatatccagaaagaaattacaatattcttctctatcatagtggaagaatagaaagaattagtaaaattaaaataaagcaattctaatgaattttttaatgtcattaacctatgcttatacaactcttcatgctatatgacccttatgtgaatggaaagccaactatttgtgcaaataaatcaccaatgtttgcataaaattcatgagactaaaatccttttttgcaagctcccactggaggtattgattgcaccaaaccttaaagaataatctgttacagactcaaattggaatgagagcaccctagggagagataataacataaaacacagggatgaactttaaatgtaaacacaggccttaaagtatagaatatagcagagtctggccaaaatgtaaagtaacagagaagtctgaagaatcagaattgctgagacctctggctgcctcactaagaagttttgatgtatttaataagaaatagggtgcttgggggaattttgaataggggagagctataggaagatgatctggttgattaatataatatttttcacttctactatgaattatgtagaaaaaaagattgtcacactctttcaaattacactactttgtattaatagtgcaagtaaaaattttacttgaaataggccgggcacggtggctcacgcctgtaatcccagcgctttgggaggccgaggcgggcagatcacgaggtcaggagatccagaccatcctggctaacacggtgaaacttcatctctactaaaaaatacaaaaaattagccggacatggtggcgggcgcctgtagtcccagctactcaggaagctgaggcaggagaatggcgtgaacccgggaggcggagcttgcagtgagccgagatcgcgccactgcactccagcctgggtgacagagcgatacttggtctcaaaaaaaaaaaaaaaaaaaaaaacttgaaataaattggcagagattaaaatgtgatttagagaaaattttgcgcaattattattcagattttttccttcatatcatgagcacggaaaattagctttttcgttaaatagtagttattttttttctagacaatctctaagatgttaaaataattttctcttgacataggtttttaggaaaacaaatgtttttctaaaactgaaaatcccttcccaaagaaataaatatttatttagatttatccatagaacccagagttaaaactataactctttgatttttttttttttaaactgatctggaatatggccttctccttcacagcagccacaaatttttctattttatgaaatggcttctgaggactgctgttatttgtggaatgaactctaagatgctaattatttgtaattgaccctagagatctttggtgtgaagtaatttgtaattttgctacggcataaatatgagtcacgcggaataggcgaacattcaggtgcaagttgtcaagctagagtgtaactcttcatgagcactaagtgtccactatccaaagaggtttatgcttctttctaccctaccattaagcgcgatggaaaacaaaggtctagagaggccagttacatttattctgtcataattcacctcattttagatgaaaaaattataatataaagctattgcatatggaaatatgtaaagaaagtgccactaatgcatgtgaaaggataggattgcttcatattacaagttgagcagatataggtggagaaagtctacctgcaagagaggcaagcaggtttttttgatagaatatctgtgattttctagaaaatctgggtaaaatcaacagaagttagcttttaagttgtaggactttaagattctaaataatctcttaataatgctggcaatgtgatcatttaggattgaatcatttgttttggaaatcataaaaatgatcaaacagttgattaaatgttaatgtcaaacagatttatgcaactgattttagaatttccatttttgtaacaagtgaatcagatttcatgtttggcttgtgatcacttggcaatgagtcaccagattggtactctaatgatctctaagttaaattttttaaacatagtatgaaatcctgtatattctcaaggattagtaaaatagctcacatcatgtctatgtcattgccaaaataattagatacttattgagaatcctttaaagtattattattagaaacagtaagtcaaaattatttgctttctcccatccgagtactaatcaagcccgatcctgcttaaattccaagattagatgggaatgggcacatttatggtgatatggccataaataaaatgatttgcctttagaaaataatttctctgtgaggttttacatgtaatggtctttgttggtttaaaactatctccgtcttatgtgaaacatttatagtgcaactacacttattgttagatacagactctgtgaatatcttcaagcctgtttaaattgcaacttttattatgccctaaaaagtagcccaatcattctgtcttctgaattcaaattttgacaagaggctctccccgtgggttgctgatgagagatatcaatgatatttccctgcaagggacaagctatcttgtcaatgttaggcaggcactgtgaattaagctttgcctagttaaaaatagtcaggattcaatgtctttttgaattatttattcttttttggaaataccaaaagatgtggtaatattcttgcagatggctgtgtatctaaggtaaatttatttagaattttttaataagaggataaagtgtcccctaaagcattgaaaatgttgtttttttttctttagctattgcagaggtggggaagagaagagagtagaagtagccaaagtaaaacaaaatgaacaaataacgacaataacacaaataaagctttctttccatgcttatattgcttatgtgtcctccaaaagatgcaaggttcaaaagacatatgaaagaagtcatgaaagttgtaacattttacattaaaccagagtaatgtccttccagatctggatctgctgttgtcttcaagatgaatgtttgacttcccaaaaatagaaataaaacacctaacctcaaatctgctggcctcaatcaaggcctgacctatgtctgtatgacctagttacaagtcagctaaccaatgggcatgggttttctttcctctaaaaatggaaataatgcttccatatgatcatccatggaaaatggctgctcttgagcaattgccagaaaggggccttcaggatgtcgctgaaccacctgcaagggaattgtgaaacccaaagtttcttcgttgaccctcctgggaaaccgggggttcttaccctagatgaatgagaactctgatgtagagcattcaccatgtgtgagccccatttgtgctgtgtggaccaacagaacagtcaagtgtacgaggtgattaataattgtgatggctgactctgatggggcgagggaatggcatatcctctagggtcctgtgctgaacaagatttagtattaaccactattgaaccttacctagagtgagcctgagtcccagtgttgctgacaacattggtagcctccccatcacagatgactcaagttttatttttcaatccatataactgtttccagatcatacctaagtacagtgggatttcttagcctctctcgcatttgacccttgtgggtgcagaagaataggggctcagatttacatgatagaacagttcttcagttccagtgttagattttctcttaaataaatgtgtaggtggaagggaatctaaagcctctttgatgctacccattctggttccctttatccagcatcttgatagaaaaatgcacagtgaagttacctccaattccttttaggttaggattttaaacaagaagatcgattttagcaaagttcagtccagatgtggttccaaggataacatcaaacattcggctgggggcggaaatgtaagtagaagcgccttttagaaagctgtcctgattgcgtggagccacctgcacagccagcaccctgccttctttcccacctctttccaacacactgctcctttctcactgctgttccacatgtctccctggtatgatagcttgtagccttgcattttcagtgatggacttcccatccttccctgtaagatcatcagggaatttcctgctttgatttgggaaagaaaaccttgatgggatgcaccatggttttctggagaatggcaaaaccacttcacttgccaactttgttgctggccttcttgtcttcaatgtattttctcacgttgtttctactccactacaaaagtcagctgggcacatatttttctagctccatttaaattacccatgaggcaaagactgatatacttgtaaatgcccaaagtatgtaatgtcaatcttcagtggttcattattcatgaaagtaaggatatcatttagaataatacaaaactggtggagcatggttcatttataattcaaagtgaaaggattcaagtccagtgtacactttagcttgatgggattttttttcctgtctctttcatttagtgtaaataatgtcctgtgagaggaagggaaagatgattccatgttttttaagtgtgattgaggcagaattgaaatggtcagacaatctcaagctaaaggaagcatggttctttataaaacaagaatagtttttcaaaggtgatcaggctaactgtattctacagatcctatctctttaaacttcagtttctgatcatccatgactcaagtaatttacagggtgtcgagtctagaatttcacctgtctactaactctttggctacttgcttcccaactgggcagaagtagaatcaagcagtgaagagagagagagagagagagagagaagcaagtgccttctacaagcagctgttgcctgataatcaaagtagcttcactgagcataaaactgtcattgtcattgaaagttcatagcaatgtttgctggcccccttcaggtatgctaggctaagcctcagggttaaactttacatttatgtggttgccactcttccttattccccagactgtaagtatacaccatgtggtactctcataaaaggagccccagtcctggtaattaccttgagggtatcagaggatggacccagctatcctttacacaagtgctgctggacaaaacacctaagtggaaaaggataaactaggataattaaagatcttaaagtaagtagaggagctttatctcccaaaacaatagtcttaaattttcctctaggaaagaatcccttgtttaaatatgcagacatcctggccctgtcctcatgatatctgattcagtaattcccaagtactctcgtgcagatgacaatggaccaaacttggagaagcactgcttcaaatattgggagaggaaatattttcagtaaaccacacagaagaaaaaaacctgttactatcattttataatttggtatgaaagaaaaatttcatctagctaagatatgacaatgtaataacaatttaggaaagcacattcagaacttcttgttgtatcttaacgttggtcttcttgtaactatgagcaacattggtcacttttatgtaaaaatcactttataaagaataatgcagctcttcccttggctctttgcttatggaaaggttaaacagtgttgcttagttctctgagtggaagcttgccttattaatatgtttctatcctcctgtgtcataatctgctttcaactaataaaatcttctattctagggttttctttcacttgggttcttctttccaatccaaacatgtgggagaatatatggaaaattatgtcttcctctgtttgtgtgtgtacttcaatttgggtttctagctatgttgttgcatgttgtgactttgggtgtgtttctagatcttatgtatgagcttgggtttttgtccatgtttgaactattttaagcatgttttatgtggttcacataggtacaaattgttaccaagaaaatagacctaagccatgtgacatccaaatgtggctctctgaagaacatccgccacaggccaggtaaataaataatttttagtagtttgagaaatatttaactggaatcaagaaagggatgagaaaattttttgttgttgcaaaatacctaattggaaggatgttttaaaatatgggtacttcacatttttattaatagaaactaaaattgaaaatttcaaggcatcttcattggggaaaagtgaacccaattacaatgaagaggacacattttaattaaaaattaaaaggtacataagacgcatttatctttatgtactcaacacgcttattggagctcctttgaaatacgtagtctataaaatacatcagatcatgtattcatatataataacattgggggtagcatttccaaggttttttttcctaaaattggctttctacattatgtaaaataaggattgtgctttgcaaagctgaagaagtgtatttatctggtgaatttctcagattctttattaggtcagtaaacaccatgaatacccagcagaatgcaatgtttcctcaacttatttgaccatgaaccccttttggtttttcaaaatatctcatacgactagtgccctaaagtagaatttatattcatagttactgggagattttctccctttaaagtgtgaatctaacattatgagtcactttttctgaatatcatgtattacatgtttttgttaaattctacctccatagagtgggcatgttggctcatgcctgtaatctcagcactttgggaatccaaggcaggaggattgcttaaggccaggaacttgagacagactcagcaacatagggaaacccctgtctcaataaaaaataaaaaaataaaaataagccgatatggtggtacatgcttgtagtcctagctactttggaggctgaggcaagaggatcacttagtttcaggagttagaggctgcagcaagctatgatcacaccactgcactccagcctaggcaacagagcaagaccttgtcacaaagaaaaaactctgcctccatagatatgtaataaaagatgactgtcatatttgtaattttcttgagaatattttgacacaattcatttatccctttgagaacaaaaggaaagcaaatggttttaactgtctgtgtttggcatcttaacatgaaaacaaagtaataggtttttttccatgaaacaaggtataataacaattgagctgttagctgacaattattctgctagtcaggagaaaattattaataaattattggttgaaaaacaaagataggtagaataaatttcaaaatggataaatgcattgaaaacatctggaaatcaggattcattttgtcaatgagtattcattataaagcaagtcaaagagttacaaactacatttatgatgtcttcacttacagtttcagaactgctgccatggaattagcttctctactattcatgacgcagcaggaaggttgtcccatacttcatatctttgaaattctcctgtccacagctgaagtctacaaacactaaattgactttgtactgctgtgtcaacagcatggctggaatacttggcaacactgcctattttctttcagaatgcaaaagaaaatgctggactcttcaattctagacagtaaggatatagttagtcaaactcacctgtgacctagatgtacggaaaaattttatatagataaggaactattctgtgtatgatttgttggtcataaaaggctgttgtcatggactcccacctatttctaaatctagctcttgcttctattataactgaatcaaatgactaaattcataaagaagtgtaagcataataatccttgacagcagcaaccttttcacaaagttactttggaatgtggaatatctaaagagaaaataaagaaaataaacatctggaggcacacactgaaatatctgttcttctcaacttcatttataaagcttgacaaagataatagtctttcacaattactgctcctgatgggtgccagaattcttcgaaaatcaaaggcatggatctctgagtttaagatatctggattctctaacagttgcataagaatttctagagggacttcatcagaaatagacttcttaagcttccttttctgaatatgttttgggtcaataatacattattatttttccctctcagaagacagttcatagtgagagtccatctctacaaaaaaattaagaataaaaataagctgagtgtggtagtgcacacctgtagtcctagctactcagagggctgaggagggaggatcacctgggcccaggaagtcaaggttgcagtgagctatgatcatgtcacttcactccatcctgggcaacagagcagaccttgtctccaaaaataaaaaggacattttagcaaaaatttaacacgattatattgacacaacatataatcagaaaagtaaatgatttctatcagaggctaccaaaaatacaaaaataagatcacaaagaagttgttcttatctagttgaaagtccagtatcctctaacctctaaccaagataagtctgtttttatgaatcattgcaaatcatgttcatctcatcacaatcaataagtgagacccatatggccaggtaaaatgtgggaagaataacactctataaaatgaggcatattttcagggaaggataactacatctctaagcatgagttaaataacatcatacagtttctaagccttaaaagaagaacgaatggatgtttctccaaaatgtaatctaattatgtaatataatttcaagaggcccctggccaggcagttgggtattaacatagatgtctagatattgcatgagaaaaatacctcatggcttaagagaccgtgaagccttaacaaaccttcctctttcgtctacagagatacatgagcaacaagaatccaaaattgcaaaatctctttcatatttccatacggtccatcaggcattttttcaaaatcaaactcccaagcaagatgcactttatgtactcaacatgtttattggagcagctttgaaatatgtagtctgtaagatacatcacaatcaacaagtgagacctacgttaccgcttctttccagaagaacgcatgtgctcaaaaccaagttgctgttaaagtgaaagcaaatctcttaggtggtgatgagcaaataaggagtccaatttcactttttatctagatcaaatacatcagcagacactcagaaatggtcaaggacaggctcaaggacaacgagtaacttgcccagtgtagaagaactttccatatttgagagcttgagaaagacgtgtagagatggggaagactacactgaagagtgcagcatggcactgttataatcagcagatcagagttctagactggttagcattagggaaaatggcatggtcaaaactctgtctcaatattatcagatcaaggtcagcgtcatattggtcctatggcatccatacaagaaagagatgatgatctgtcactccatatatgaaacgggaggcttttaaagcttactagtcataaacaacttacctcccgactcatttcatcagtgaagctttcaatgttgaacattcataaatgaatatattgcccacatgtgcaccacttccagcctaaatcttctttggataagtaacctgttaccatgaatataaagaagagtttcatttaaatttaatttggtcccttagaaataagagactaaatgttccaacttttagaaaggattcaaataagatattttcattttgctaatttttagagttcttgttataccaaaaagaaaagcccctctgatttcttaggttagacatgggtaaaggagaaaggtattaatacgtgaagcaatccatataatagtataagaagggtgttatggtcttgcatcatatgaggaaatgatatgggctagaaattctaaaagactctttttacatatatggttggagggatggtaaagttaataaatttgtggtttgccgtagtctatctactgcagtcatttttgggaaatagttaccacgaatgcaagatatagttaaatcaaggtatttcttccctcataggtggcggacgtgtgaaaattgagagtgtaaaactagatttcaaagaaaaggcccaagctaaagttggttctcttgataatgctcatcatgtacctggaggtggtaatgtcaaggtaagaaacaaggttatgagccaatcttgtctttttaaaaaaaattcttctgaaatactcttcatcaaaataggtcccagattgtagacctggacaaataagaagtggggataacagaggtgaatagaagtcattaatgtcagccctgggagatggagaaagaggtaggggccagttaagatgcatgagttaacgaggactgatgcttgtcttaaacagattgacagccaaaagttgaacttcagagagcatgctaaagcccgtgtggaccatggggctgagatcattacacagtccccaggcagatccagcgtggcatcaccccgacgactcagcaatgtctcctcgtctggaagcatcaacctgctcgaatctcctcagcttgccactttggctgaggatgtcactgctgcactcgctaagcagggcttgtgaatatttctcatttagcattgaaataataatatttaggcatgagctcttggcaggagtgggctctgagcagttgttatattcattctttataaaccataaaataaataatctcatccccaaactgtagtaattgttacaattttctatttaaaaaatgaatagtacatgcagaaattgacctgatttccatttgcaacaggaagacactggctttacatgggttcaattggacaattatttttgctctgctctgttttgcatggagtattattattttaaaaattgcatttttacctttcatgtgcctgaaggctatccactacattctgaaggccttgttaaaatccaagctgctcatttcactattctgtttctgagtgagaagataaaaactgcccattgtaacttatttcaggttaaattaaaccaaggagtctgattgcaggaagggaagagcatgtaagaaataagtttttttaaagtgttattttgtataaatgggaagaaagattcaattaagttattaacatttgggacctggataattatatcagagtatgtcagtccaataaattatttaactaattaaaaaatagttgcaaagcatttgagctgtggttgaggaagtggtgtaaaagtgcatccattaggaatgatgcactttcattaggatggactcgtgtctgattagaatgtcagttgatcagctagatttgtgtccacactaccagtttcacaccccctttccatctgtttgatacagtattatagatataaatatatatatatttctctgtggccatttgtgatacttcctcatatacttgaatattatacttctttattcacagtatctgtgtctcctgcaccctttggtgttgcaattttagatatgtgaaagtagatgttagcagggttctctccctatttaaaaaaaatacattaaaaaagacaaaaaattttagcatgaagttgctttctgtaacaactcaaagccgtaaccctgttttagtgccagatacaagtctctcccgtgatgctagacaaaaaattatttttctttgctttcaccaacatggagtttgtgggggtgggtccagttatacatgaaagggtttacagattgttggtttaagattatggatttatctcatttttaatcacaggatagtttggggtttattcctattattattcatgaaaccgacttaagattttttctttatttttctttttttttccatttgctaaagttgaaagttgaaactaactataatagtttgaaacatgttttctcatttttccaaatagtatctgtttattaaattctctaatagaagatgtttgtctttcttacccaaagtaaagatcccctgatcagaaagaaaaaatacaatactttgggaagctatagctataaaacacttgagacacagatatctaaatcagtttttttccaagactccaacattgcactctgtaaagtaacacactgtgatctagtattatttatcagtagataatactgttctgactgtatatacagtctagaactcacaaatcaattagttcctctcacaaatcattcatcttagacttacaaataaggaatgaaatagtcaatggcctgattaaggcaaagagctaccaggctagatggacactttttaaaaattttatctgttctttttcttgctcagggctggtaggttggatctgaaccattaaaatcaaatggtccactaggcgtatgatctctttgagccaaatcagttcctgaatataaaggaggaaatgatgaggatgtactgaggcaacggggaagtatagaaacatccaagacaaaagccaagggatgcaaaggcagagacacaggtgctttttggtgacccagtggatatggcaaccagtgtaactgccatacaagaaaccctaggagcaaacccacaccactcattctcagctaagagattttacacaggcaaacgtgtcttaaaccatctataaatcagttattttatatgacagtcaaaaccttagaaaccttaggatcattatatctattttctgcctattaattgctgtgaggtttgatttgaccaatctgggcaatttattcatcagcttcccttgaagtgcaccagaaaatagaagaaaggtgtgtggagacttagggtattttattacatgttttcatagtcttaaatagtgattaaatttctctagaaagaagttaacagctcattagaaaagttttaacctgtgaaataagtatttttctcaacattctttaaagtttttatataagttaacactaggtaaacattctgcatactagaagtcagtttattacaaatacatgtcaaaaataaagattatacaaggcaccaaactactagatttggcattaaaacaaatgtttatttctaatcacaacaaaattataatgaataaatgttcttgctttgtatggaaatacaattctttattaaagttaacagaaaggaactgatcgtttgtaccagtaaaagagagaaacacacaggttaaatatcttcttgtggggttaaggggtagaacctatcttgccttcactctcaagataacgactcaaattaagctttttgagcaccactcttgtggggacacacatacgctgatctaggaatgaaatcttcgtggtctcaattctagatctactatgccagtttctctctggctttagcctttgagaacctgtataagaatacgtaagtaatccagagctgtgaagagtttaaaggccaacttctccagtgaactcaacctctgggtcacttgcaaccagaaattggatacctcataatgatgcaggaaagacccgagttcatgatgagtttcaaaggccacgttcatttaggaaccaactctctctggatttacctgctgagttccagcagcgtgatgggctgacatcccacctacaagtatgacacctgtgtaacaccagctaggtacggctggagaaggctgaagagagaatgccattaaatggaagaatgtactgattgtagtgaccttctccacacacacacacacacacacacacacacacacctacagtaatacagcaagcgtggaataatcagccaatatataacattccatcagtattttattaaggaaataacctgaatgtggttgattttgacatagctgcaattacagttttcttctatttttcaagccacaataaggaaaataaactactcatggtctaaatactagagataaagtagattcatggcttggtaaggaaattttaagcattccttcaaagattgacgtgctaaaataagcattgatgttttgagtttttttacacctaggatttttagcttgggtgtgtaggtgaaggccaagactctctgcaggaaaaagcttattttcaaactcagaaaataaaatgtcaatcataaaaatctacttcaactttagcaaaaagaaaaaaaaatcaacaaaaagtatactctgtatgctgggattccgaggttccaacacactgttacaaatctgtggggggtttctttcttctgataattctagagcctgttaccatagaaaggcatttcttcaatggctggttgtagttagttcatgtttttcaatcaaatttgcaaatgtatttgttgctgtatagtgattgttttgcaaaataaaattgcttgtcacct

SEQ ID NO: 790 - DNA, 204645 bp, Homo sapiens
ataatggttatatgctttttatttgtgacatttgaatacccaagctcacatataactgatttcctaaatatcatttaattttatgttgcttttctaattgatttaattgttagttttccttatagtcaaatgcttaatacaatcataaatggaaccaaaaatatagtaaacatttctttttctgatgtatgtaaaaaagatacaggaaaattctgaaatcagatcactataagctagtaaaacaggcgaattatttgattagaaatggactcttccttcataagttacacaaatccttatgtagtcactgaaaattcttactcagaattaatacctgtccagagggaaacagcctgttataaaagctttctgttaatatattttttaaggcaggaaaacaatcattatttccaaacacactttgtttgtctaattctaggagagaatcaccaatttcttcaaggtccaaaatgatcagaacaagaatgacaacagtgtcaaccaaatgatgcctccaactccttttaatgattgtgccttggtacacatttcctcaaagataatggctatacttttcccacaatctttttgcttttgttttctcccagtgtggtactcatggagtatggaagggacataaggtttagagaacataggaagcaatttgcttccatcaataaccagaatgatggattgacataaatcagcacaaaaagataagtgtaattctattcaagtcccttaatgttttgccaattaaggtttttttttttttttttttgaaacaacaacagtgtaatctttaacagggatgttaaaggtaagaagtcaggaagataaaccaaaatgattgagtatgataaagaattttgcatggcgattaaaatagaaaacctataaatgtagaaaaagcaggtctggacttagcaaagaaacaatatagtttggagaaggcatgaaataagttcttttcatgttcactgctggtcacagccataacagagagtgatgtggagagctttgggaaggtttcacgttgagttacatcagtggtcaacaatggagcaacaagactccgtagaggatgccaccctgggagaattgcaagggaaaggaggctgaagcacaactggtaatagccttcagatatttaatggatatgcaaataaagctctgattaattgtattttcacttattatatatcatctttggacctttctaaaagtgggacactagaaaagatatactgaaactcaaaaagaatacttcagctcgagttgaatggaattcaagatgttgtggagggttcagtgggttggttataccaaagaatgctatagaatttccatgcccgaagaactgtgagaggagtatagattttttcaccaaggaagttactggcatggtttgagagatagaaggaattgattaagaaacctctcaaagtttcttccacttaacctggctctgagactctgggtctttggaaatgagaaaatacccagggaagagaaaacgaacaatttaagaagcaggaaatgactctagatcagtatttctcaattacagccgtgtaagacattttcttcctaatcatctctcccttgcaccatcaccatgaaattttaataccacataaatactttgtatctgtttatgtacttgtgatcctttggagggtcacaactcactgtactatctaagagttttcccaaaaaaaccatctgacaattagggagtgtgtgctctctataaataaactatgggtccaaatgggaggtcattgaagacgggagaaaaaataaaagcgttgaatatttcacctctggctacagggagcatacaaatcctcacttgcccatgctctcacgtattgcctgcacatggaaacttccttcttcccctccctcctgttatatggaaagggatgaatgctttgctagtgctatatcatctgactgcaatgcttataatattttggggatcctgggcctccttgagaacattaagggatgaatgtacgtatgcacagcctcacactctataaatgtatgtgtcctgaatttcagagcttaataatgaattatggaacttgataatgattggatcaggcagacaacacctgatcagtcctaatatcagaaaagagacaagtagacattatgtgcttcctgaggtgaggcagtagtaaggaaacaacatcacacatgtagcagtcttgggaaaaaaaatgtaacctgtatctcgtaatgaggaaacaatcagtaaaaaagtctagattgtgggacattccacaaacttgcctgaactctttaataatgtcagtgtcatgaaagacacaccacacacacacacactgcacatcatacacaaacaccaccccaccacccaccactcagacacacacaaaagggcaactctaatcaattaaaggaaacaaaagagaatgacaactacatataacgtataattcttgattggatcctggatttaaaaataaacagctataaaggatattttggggacaactggagaattttgaatatggatcatatattagatttatgcagtatcagtgttcagtttcatgggcgtgaaaatattgcagatttataggacaatgctcttattaaaagaaagaatatgatgaagtattttacattttcatgatgtctgcaacttattttcagaaggttcaagaataagaatgtgtatttacagtgagaaagaaaatgtgaggcaggtgcggtggtacatgccatagtcctggctactcaggaggctaaggttgaagctcacttgaggcaaggggttcaaggccagcttgggtaaaatagggagagaccccttctcttaaaaaaaaaaaaggaagaaaagaaaacaaggcaaaacattaacaactgatgcactaaaggacataagggtactcactataatctttcaactttgaaacttttactttaaaatttcccaaaattaaaatgaaagcagaaaaagaaggagagtaggacaggttaggaagaagaaggagggttgtcagtctctgacccagagggctgaagctccatttataacagagatgaacagttagatgcagtcaagcagaggagataaaaattgactgcagagattttcttcagaatgtgccaaagttctgtgggaacaggaatattctgtgattaaaaaaaaaaaaagggtagtttgccagaatttaccctagaagagttcattagtgcaattaacaatataagcaggaggaaattcttccaagaagcttaaaaagatttggatttttaaattgagtggaaatttcatatgcacagttaataaaaaataaccttaaaaagaatgaataacaaaggtctccagattccagcctcctgctcgattatgcactgctgaaatgcaggaacatattcaactttttaatgtaaaaatcctgtggcgttccatgatgcacagctacagagttcctccagggcatgggctccgtagttacctctctgtgccactgtgctgcattcccatctggtaactgtgtattgcagaggctgggacttaggggctcttgtttctgttctctggatctctgtgatggtcagatattcttttggccaaaagagatgtagggaaaaaactttgcctatcttgtcctctcaaagttacttaggaagggggacaaaagtatgtttattgttgaccagggcacagcaacatggtgaggtagcagcaattggattccgtgagatgacctttacgagacacaaagcaaggttcaggctgcttggttaggtcaacagagaatgccactgtacccacagagacagccctttcttagcttggacaaagatttcatgattctagtcttttgtggcagccacagagggctttaacacattatgattgataaaacaaaatcagagtcatttagttattctttaatcattattactttaaaatacactaatacattcttatctacttccctccaccgacaaatattttgctaaattaaaaggatcactggaagtattatgacccccctcgtcacaggtggtcagaaccaccacagttttgtgaatgaatcagagaaggcaacatttcatcaacgaaaactcatttaggtttcaaaaggcaggatgtagtacagaatgcattattctgactgtcttctggaatagaaaaattggaaaggatgaaagaaggaagttagctccagctccactgttaccttggcaaccgtggcccaatcacaggggcagaaattaattttgtgccgtaacataacgtggcagaggagtggggagcgtggagtggggagagaatgacggctgggtttaaatgctcagaaggctagtggggagggttacaagtcagccgtctgggtgttaaatctacacgtaccaaataaccaattgtacttttttcactgaaatgttagtattatgtagagacagccacgactccctgtctttaataaagaacaaacactgcagtaatcatgcccaacgctcccgctgatcattcttagttatttaggacttttatttctctcttctgggaaacaggaaagaatatcttccactgaagagacaaggaatgatggtggttataaaaaatacattctgatcaggtgaactggtaacttgtcagctttacgctagtaaccagtctcttccctgcagttagaacgtgaagaccctgtttggggcagagacaagccaccccatggagtgtccctgataaaactatttattagggaaatgctatggacgcctcggcagggagagtagggaggtgcaggggatgggtaggggttcaggtgtctcagagctccacagccctgcacagtgttaaaccacagatcagagcaggagcttttagagacctgaaaggaaggcttattgcataaaaacttgctgcacatccagaggtccaaaattcacccggcacttaaaaaaccaatcacagagaagtcggccagctgacaagacagataagtggaaaaatacgaacacgcatctcagtctcaaaacctgaattccagtaaagcttaggcggcaggtcacaggcagaactgtgccatgtgtggaagtgcagaggcttcctcgtggacaattccccagccagaacggtcaaggggctggtccttctttcacgttgtggtctgcctcgtccacaggtctgggctagcagcactcagaaggttaagagcacacaaagtgagtggggaatgtctctcaggagtcactgcttgcctccacctctgctgttcctgggagtaggtgtgtcatttcagccagggtggtccacctcctgcccgctcagggcaccaggaggaaacagctttcctttcttccaaagggtgaggtggagcattagtgacacatcctgctcgtcatttctttctggaaagcaaggggaaaaggatggttaggagaaactataagcagagcaacgatttggtgaaggatcctgaaaatgctcttggaatctcgagagcctgtaaatgaaagcttgcaagcatggtccatgaataaggcttagcatgagggtatgttccatctgtttgttctgcagaattttttttttccattaaggcactgtttaaaaatttgactcatgtatcaaaattcaggttgcttgcttgctttttctgagaaattgcaagatttggagcttctgaacaactggagttgaagaatggctgtcctcttcagcagaagaatttgctctccagtttgccccagtccttgccactcccacctgacttcccagcaggagccatgtagcacttatgaactgatacagtaattggatttggactgctagttttcttcgagtagggaaagatttaagtttcaatcaaagatggaaaaataaaggataagtgggtataagtcaagaaaagcaggaaggaggacatttttaaaaatagaaatgaataatacaccaaagtgtctgacatgcgtcacctgcctggctcttgtgggtatttatagatcccgaatagccatcctttctctacccctggggctccgcacaggttgagtcccatgcctatggtccgctgctaccacatcctgcgcctgcccctcttcatttgtcaaattgccactcatttttccacctcaggtaaggtgacttttacctgctgggagaccttcccgcactcctgccccactcgctgtggaggtagccactctctcctcctgtgcacacattgattcttacatgcagtgtatgaatttgtacatctctgtgtgtgtgtgtgtgtactggggctctggacatgtctgttggccctgctagactgggcgctactaagtgccaggaaaaagaagcactcattgaatcgccccatgtgctttcatctttgtagcccctgcccctggcactgtgccagggtagtggctcctctttcatctccaaggatggtctgaggagcaggctagtaatgagccctgtgccatttagcatcttgagaagacaagtttcatgtcactttagttagatgaacgatcttccaagttctacctgctgcagagctgactgcagctactacatctcttgcatactgacctggactgccacaccttatataataggaaacatcgagaaaaaggagactgagtgtgggagtgccaaggtgttcagagaagcgttctattcgaaaaccatacagatgtgctggttaaagaaataacaatagacaaggcagaatctaggcacttttgcatctctataattattaatacaggaagttacaaatctatgtgtatatctaattttttcaatttttaattttttcgacaggatcttgctgttgcccaggctggagtgcagtggcaacagctcactgcagcctcaaccactcgggctcaagctatccacccacctcagactcctgagtagctgggactataggcacacaacaccacacctggctagtttttaagtttgttgtatagacaggatttcaccatgttgccctggttggtctcagactcctgagctcaagcattacccatcttggcctcccaaagtgctgggattacaggtgtgaaccactgcacccagcttttggcttaactcttgatgacacagacaaggaaaacaagatgggaatacaacaagagcatgtgtgtgtgtgtttgagagagacagaaagagaagtagggagagagaaagtgtgttcatgggataaacagaattttagctttataacttaattatttgcaataggtctgtacttttgaaaagaaagaagctagctatagttaaatatctataagatgccaggtgctttggggtggttataccattgcatctgtataactctaagacagggaactatgacctccaatggacagaggaagaatcccagtttcagagcagaagctatttgctcaaggtaaatgggtaaggtacagaatgctcaacagtaaccgctgcttttattaaacagaggcctgctgtttgccagtcccagtgtctactgctatacagatattatactttgtgaagtaagatttgccatctctactgtattgatgaggaaaaaccctcagggaaggagagtaccttaccaggtcacatagaaagctgcaggtctacggtttaaactcaggtctatctgaccgcaaaggcttgctctttctactacaccatgtgattgtaggttaaagcctctaagatagtcttatgaatatgcaatcggataatactggcatatattaattgacatatataattataggtggttgcagtcattcatgaattttcaaaatgccagatttttttctttatccagactgatgccagtttgaattataggtacaatgggcaaatactagaacaattatgccactgagagagtatggacactagaaatatggcagagtttttttttaagtagcagagtaacagtttcagagaggacagggtacttattcaaggtcactgagatgcaggataaaaactgtttcctgggatgcctcttaaattcataaagggaatgtatggttgaaatagcagatcagaaacatcaggaaagacatttgagttggatccatccttcaaagctctgcaagactctgcaagctgtattctagcacttgcccactgggtggagccaatgagctgttaaaaaaaaaaactcgtttaaataaacaaatggcaatgctaggttccatcgctttcttcatcagagccctcccgcaggctagcagggccaaacacattccttcctctctgagagtgtggccaaaatagcttctacccagggtgctctttacaatgaatttgccattgctggagttactgaatgccctgtgtattaaggcaggccactaaagaactccaaaacgtgtattaaaaggcttccgctgaggtgatgagaagcttctgagaaagttcctggtgactgtgcttggcttgtatatgaagattttcaaaaacacctgaatttttcaaaatgtgtttttaacagaagatcaaagtagaatcttggttgtggtcactcggtttcatttgttttaaaataaagcagtaattgattctatgaagtccctggttctccactgtcaacaaaacaaattccatcctctgaagcctgtcaaagaaagaggacccatcgccccctgctcacctcctgctgaattccctcccactcaccacaccagccaggcaaactagacttctccaggtctccaactggccagtttctagtggtttctttcttatatctggtaaatattttctgcccttctctgcctggcaaattttgacatcctttaagatgcaattgtcagctcctttcttgggtatctccatcactttgcacacatttgcattctatcacattggaattcatcatttcatttttgcctgaatctgagaagaacattaatattttttagtatattaatgtatgatgcatattttattcaaattgtataacaggatgtatggtttgatccagttattttgagaaaaaatataaagaaaaatatgggtccaacatgataaatttatctttgggtgaatacaattgtgtatgttttctgtttctaatttttttgtcctttgcggagtctgaagttttagatatttttgatatgcatgaatttttttctaagaaaacaagaccggttatttaaaaaacaaaaaggaaagtagacagagactccaatctgaaatcatatttcactttagaaatgaagttaaaatgacatttgcctagtttttgtggggacggtgggggtggatgaaatcagcctgtcttttacataagatactcaattttttctgttctgatctaaacactttttaaatttaaatcttctttatgtacttgttagcagttggaagaagttcttgatagccattgaacaaacttccgtgaactctaagtgtcaaatcttagtctaacctcagtgtacccatttttataactggtagtcagtggaggatagggaataatgatccagagaagtaaaatgacttattccaagtcacacaaatactctctgacttaggcaagactacaaagaaatcaacgctctcagtttactgcactacatcatcacacattttagtaatctaatattcttttttttctttttctttttgagatggagtctcgctttgttcccccaggctggagcgcagtggcgcgatctcggctcactgcaagctccacctcctggggtcacgccattctccagcctcagcctcctgagtagctgggactacagatgcccgccaccacgcccggctaattttttgtatttttagtagttagccaggatggtctcgatctcctgacctcgtgatccgcctgccttggcctcccaaattgctgggattataggcatgagccactgcgcctggcccaagaagctaattttcatatggaacatatgaagaagaacacttgatgtttactaggggacagtcatcatgcttgcacagcaattttaataagttaactctaggaattatgaaacaagcgccaaaaagcagtgacatcatcacagagtcataggctgctgttatagctgggaggaaacatgggtgtcacctactccaacactttaatttcggagatgtggcaactcagaccatcggaaagtaagtgacttccctaatgcggcaaaactaattagtggcagaactggactgctggcctgtgggctctctgacttcacattgattcgaaagaggcaatttgtgtacacaggatttcttagagctggcttgatgtgctgcaggtaaaatctttatcatctcatgatgctcctaaactccattaatggctttcagtagttttcaaaccaagtctccactgtaacatacgatgctgttcctgatctagactcttctcaggcactcaacctcatcccccatcggtggccgacgctccttctctcccatggaacacacaacgatttccatacacatgctcctctcttcccagaacacccttctcccatcgccaacaccctttaacgctcttgaccagttgtcatctccttagggacacattcttctaccctcccaccctgtccccaaggaatcctaggtgctcctcttccagattccctcagtgcccatgacacctttcacactgttgtgcgaccgtttatcacattcctggtttcagcaccaggctgctcttgaagagagaaaacctatctggtatttgtgtagaccctggtgctcaagacctggcacatactaggtgcttaaaacatattaaattaaactgaaatccaatgaaaaggaacacttattaggtctacagacccaagtaaaatgagaggtggaaggaaacacgcatttcatacctacgatggggaaggcacttagacttaccttgtgcactttctcacaactctatgaactaggcattactttttctaatttacagatgaggaaaaggaggcccagaaatttgaactaacttgcccaagttcacccagctagtcagtgtaacaataatgatttagtggactcaaaaacaaaaacaagcaaacaacattctgctttcattactctgctggagggaggagcaaaagaaaaggagtgagtctttttgtttctgttgtaaaatggataaggggggggaagagctaccacagcagcatttcaaaacccatgtcttcttttaattaccagcttcctgctaactctgagacaccaggagaaagggggaggaagaaatacttgaaacaaaaaataatcaaggaagaaaagcagtatgaagagatgtagaaggctccgcagtgtggtaaggagcaggaggacccttggtgctggaaactttggaaaaatgactgttatatacgtgaactcctgcccctagtaaccaccattaaacagccaacgggttaaagcagggcagtgagcagtacgcctctctcagggccacatctgacattatgttgtgtacttctcactaaccattttaaagccgttggatgtttaatggtggctactagggggaggagttcacgtatataaaggaaattgggctctctaatacagcacgcccgcacacgtgtatactcatgcgtacacacccctgaagtaatggaaacagaacggaaagtaggagagattcatctcccccagcaccttttccaatcatgcagcttcatcaatacattttaaaggtaaaatcaaatgtgatattgctgaaaagacacgaggaaagctgcgagtcccccggaaaaggccgtcaaagggtattgcacgtttcacaaagtgcctccctgcccattaatcagcagtgcagcctcagtcccagctaccggccccgtgcccgagcttggccctgtggcctgccgtcagccccatctccactcagatgggacatacctggaaaagtggcttgaactgcagcagaagtacagaagccacatttctggctgggctgggggtggacagcaccaaaaccctacaaccgggaagagtttcattccccacagcaaggctaaggccctctaggggtagaggccaggtcagaaagagggctttctggaagcctttcgtctcacaaattccacttcttagagacttaaaaatctccagattgtacccatatttcattagtttcttctgtgatggctgtggattgagaacactgaccatcttgaaaattccctctctcatggctttcccctgcccttcctgcctccattccaaacagctgtgctggcgaggtctatgccaaggtttcacggccccctcccaacagggtcctcagctcctgccagcactcacttccctcaggccacatttccacactcaatgttacaccaacattttgctatttccttatctcaagatctaacccacttatagcaaaagcaagtccctctggactgggtagttttcttggaggagtgatgaggatgagaccaaagaaaatgagctggcatcagcaagggattcgggttctcagctataccgtgtgggcccatttgaaatcctcttggactgtagacagggacagcaatcagtgaggtttcttctagtgtcgtggcgctatgagaggcatggtgatactgttgtcaaaagaatcccaaggcaagggcaggtgtgctttcaggggctgtggaatcaaaagaggcagtggtattgtggtaaggcattcaatgatcaaaatgaaaaccaactgttctctctgaatcgtccagtttgaagggctcagaattccctgtggcaccatgctgcctgtggtcctagaggtaacagccacatgattccagtatgcaccaaggcccagaagcaccactctctaatgcctgctggtgtcctcaacagcactggctggaaaggtactgctgaagatccagggagaaataaaactgttttcctgcatctccatttcctactagatcaagtcctcaacttcccatgacttgcaaggacttctggatctgcttcccgcccctgtctgtggccttgcatacaccttgcttctgtttatcttgcatctttgcacacttgttccttctgcatggagagccctatttccttgtttcctccagagcactccagttcctctttcccagccctgcttgggtgtgggtgaagcttacaagccacgtaggtgggagacagagcaattcccagaaagggagcagaactctgggtgtgatgaaagagagatagaggatcccagcagcgccccagagctggttgctaagaatttgccctggcagctggctctccttcagacgggggtgcagttctgctttgaaggtgagtgtctgacttcaaggaagacccatgaaaaacatcaggctgcttgctgcagggaaatccccggaaaaagagaggagagaaaaaaagaaaagaaaaacaaacaagcaaatacaaaacatcccaaacaactctacagccaagtccatgtggcaaagcgggaaccgtagaaggtgggaacaacagcagggcagctcttgcctggcctcgggcacagggaggccactgtgtcgctgtcgggaccacagctgtccaaacgaggctggctccccacttcctgtggtgtttctcttttagctttctagaatccaaatagctgtatgtatcagaggaaataacactggccttttcccaaatgccttggcaactccaggggaaggacccctcccaccccgactccggtggacaggcaggtaactccacaagtggggcctcctggggcatgactttctaaggagccctcagttgcatccttggtgcagagtgagggtgagtccagggctgcttaatctgctttcccggaccattcccagctgtttgtgtgaggctgtggagggagtgctgcaagttagggatccctgggaaccctcggggagagtctccctgccatgcactccccctaggctcaggggacttcgttcttgccctcaaggccttttctgcagtggtcaagctggtggagcttcctgcctggaagcttgttttcagaggagggtaaagggaccaggagtcaatggtggaatccttaggcgaggttcaggcatgaggcctaaacatttttttaggaactatttttttgtaacgttgttgtgtctgtttcagagcatctgggagagagaattccagtaggggctgacatcagccaccccaaatttattttggaactaggctttattggtataaataacttgagaagtgaacgaatgaatgaatgaagccgtgccaggtcacaagagtcagagtgaacaagatggggcagtgataagagagccatcattaaccaaagtgtcttgtgttccgaatggagtagtttctatcatttcctgcaccttttctgtgtgccaggcactgtgctcaatgctggacatcatttcattcaatccttacatcagtcttatggggtatgtggtatcattcttattttacagaggggtaatggaggttaagtacctcggccatggccacatcactaataattaccctggccaaggttgaaacttgaaaacccatcctcctaaccagtctactatatcctgagccatcgtgctgaatatatcttcattcatatctacatgtgctgtttcagttgagtctctgaatcagcggctgtaccacaccagcatgggccacgggagtagggactcggctggcaggaccgttcccaggaggcccacagccagggctgctgttcttcctttgctagcatcccaaagtctgaattcttataaagcaggcagggcagccagtctacaaaaatatttttaaaatttccccaactctaagtatatacaggatccaaccagcacacaggaattagaaatgttctttctgctctcttttaggaatgtgggtggcaaataagccaaacgaaataaaaatagaaacaaggcaggccagacttccctaaaccacacagaacaatatttatttgattaattctgttcctaaacaacagcccacattactgacacggagggcgtttccacgatggaggggtgcgtgtgtgtgaatgtgtgcacatatgtgcaggctcccaagtgcacatatacatatgtatggctagataaacacacacactcgccacccacggagaatatttattcataccgatacaaaaatcaaactgctcttctttttccaaaccctgcaaacattaaaaataagtcactttatgtaaacatattcagcctcctgatttacattgtttcttataaagacagagctgcacatttttgaagttctctcatttaaccacaggagatgggttacggacacatggtgggttgcctcatagtgcatcgtgaaagcaagagcattaatcaaaactgtttgtggtcactgtatctctgcagatcccctccctagagccccgcagcccacccctcattctgcaactctgtgctttttttttagcaccctgtcttgctctgtggatccacctaccatgtccttcccacctgtatcaacctggctgatgcactgatgggacaggggatccaacctgatttctgctcagactgatgctacctgtgatcaaaggagcctgtgatttctgctcaaagcgacactgagatctctgacatttggctgctgctccccgctcctttcctcctctgttacccaacttctccagagcccccatggaggtctgcacagttggcaggagtctgcctccctccttctcatacccagcatttgtcagcgcagctggattggtttctggcagatgctgctgctgccccttgttctgggatgagcaaagggtgactgagtgcacccacccgctttgaggaatgaaacagatttcagcatggcccaatgccccctgtagggttgtgcagttccttaaaggctggatgcgggagggcaggggaaggaattctcacatttgcttctgtcatgtggcctttctatcaggagtgggagggaaggcactggccggtgaagcagagagtaccggaaactccaggttaggttgcaggcaccagagttttatttattctgacagaagcttaatgggggcaactcttaatgacatgcaagaaacgctgaacaaacggtttgtccttttggagggagtattctgaactttcagagcatgggtccctaaaggaagaatttacctcccctgggaaaacaaaggattccatagaagccgttcagcctagctgaattcaccacaggacagagcttgccattgcttaataagacctctattgtgtgtctgatgaaaacatatggggaatgtgcttcctcagtgagcctgtaatttaggaagtctgtagtttctaagcagtctcactcctttggtaggaacaaagtgttattttgatggagtaaatagacatgaaacaaaactaaaattttccttttaatacaatgagatctcttgctagaagtttgactaccacctattgaaacatgttctcaagctctcacagagagaaatttggtctcgtgagagcctcaggagctggtcaccactttgtgcccgactctgtcactgactctcaggtctatggggtggccattatgcttcccctagagaggaactgaaacttggaaaggttagtgacttgcccaaggttacatggttgatacttggcagagcgagaattcaaaccaggatatcatttggatcttatcaacaggcctcggaatcctatctttttttctatatcagggaccagaaaatgacagttcatgggtcaaatccagtccacacctgtttttgtatggcccataagctaagagtggtttttacattttttgatagttgaaaaaagaaagaatattttatgacatatgattattttatgaaattcaaatttccatgtccataaacaagttttattggagtaagccacacccatttatggatgaatgcctgtggctgcttctgcacttccatggcagagctgagcgactgggacagagcccggcatttagcatgggggtcttttcagaaaagctggctgacctcgcgtcgcaccatgccaataccatgaccagtgagactctctagttttgacccacatggttataaatggatccccaagctgcctttccaaaactgacctggcaataaatagtccaatatttatttaatctataaatagtccagtcttctgtcttgggagaacaatgatgttacatcagtagaaaaacgcttctaaaacaagagtggagtgaactctacatgcctatagtcccttagaactaaacccctctccctccccctccccctccgtctccctttccctcgtctccctctccctctccccggtctccctctgatgccaccaaagttgtgaaagccaaggctggactgtactgccgccatcttggctcaccgcaacctccctgcctgattctcctgcctcagcctgcagagtgcctgggattgcaggcgcgcgccgccacacctgactggtttttgcattttttggtggagacggggtttcgccttgttggccgggctggtctccagctcctgaccacgagtgatctgcctgcctcggcctcccgaggtgccgggattgcagatggagtctcgctcactcagtgctcaatgttgcccaggctggagtgcagtggcctgatctccgctcgctacaacctccacctcccagccgcctgccttggcctcccaaagtgccgagattgcagcctctgcccggccgccaccccgtctgggaagtgaggagcgtctctgcctggccacccatcgtctgggaagtgaggagcccctctgcccggccgccaccccgtctgggaggtatacccaacagctcattgagaacgggccatgatgacgatggtggttttgtagaatagaaaagggggaaatgtggggaaaagagatcagattgttactgtgtcggtgtagaaagaagtagacatgggagactccattttgttctgtactaagaaaaagtcttctgccttgggatgctgttaatctataactttacccccaaccccgtgctctctgaaacatgtgctgtgtccactcagggttaaatggattaagggtggtgcaagatgtgctttgttaaacagatgcttgaaagcagcatgctccttaagagtcatcaccactccctaatctcaagtacccagggacacaaacactgcggaaggccgcggggtcctctgtctaggaaaaccagagacccttgttcacatgtttatctgctgaccttccctccactattgtcctatgaccctgccaaatccccctctccgagaaacacccaagaatgctcaataaatactaaaaaaaaaaaaaaaaaaaaaagaactaaacctctttggctttcagagtatgagaggagacaagtccttttctttccttattctcagactcccagtgaatgatccatgaaaacaatatgaattttacatacaggaaatgtacttaataaggcaaaagcatttttactgttagggctccttcctcacctgttcgtcttttattatgaggctggaattttagcctttttttttttttttttttagcagtacagggcattttatgctactgttgttacactgcggtttgctctcaatataagagggaaattgtggaatgcattgaaaattggtagcagcactggttcagttcaagagaaataaagcaagatatccttttacttcacgtaatttttgttccccatcctggcctcacttgcaaatcctaaagacccaattcatatgtgaagaaacaacaacaaaaacaaaagccataggtaccaagatacagagtttgaagctagatagatgatggtaatggttgcatgacaatgtgagtgcatttaatgccactgaactgtacacttaaaaatagttaagacactaaatttccttatgtgtattttaccacaattaaaaaaatttagaaaggaaaaaaaaaacatagctatccattttagaaaaaaaattcaaaagcttcaaggaagaagatttttacacataaggccattagtgaaacgaaacaaaaatcctcataggagttttgaaagatttgaggctttatggggacaaatgagcattagtgcatgttcatgtgggtgcttgtgtgtgtaatgtgtctccaagaaaacatccatgcccaactaattcagttccctctgttattgctgtcagtattagaaaaatgagaattattccatttagaataatctccttcttttaatgcaaaatgccaagtaccgttgcactagcaacaaaaaacaaaatagagtaactatgtctgagaacctattataactccgacatcttacaccagtgacaccaaagggaaaaaacacacccactgagcacctatgaagattcctctgcagtatacgtacaaaggctgtcgtagccgtcagggaaagagtgagttccagagaaagaggaaaccacaatagaaaccttgaattaaaaatggaatttagatatgggcaagagtgccaaccttaatgaaaagtcttcttcttcaatcattaggctgtaaaattaaagctggatgtggatgtggtctaatgtctactttgattcttgtgtatttgccaatgctctccaaaggtgaataagatgaaatcccttctggatgtgctgtgagcactctggtcctttccaccagtttcccagagcataggtgccccacagtgcggtttctgaaggctctactgtttggaataggcacatacaataacaaagctgcttacagtctcggcctggccgcgacagggtcaacaacctaaatgccaactggcgatgacactggtcgtgtcaagtgaagccaatgacaaaggaacagccatgctctgtctcttggtgcccacagcaatacagtcactgtaggccagcaatggtgatccagtatgcagcagcatggggtgaagctgacatcaacccaataaatgaccactgtcttgtcgtcttcactgaaatggtgcatatgcctcccccaagcccacacacaaacactttgcttcatatgcttgaaagttgtgggctttcaggacaagggaaaactaaaaattgctctctaaatgtgggcactgtggatgtgttgccaggttgtaatgggtcagaactgctcctgcccaccataggccctgtatgaaccatgactgcaaacagatgatccctaagcaaactgtactcccagaaggggtttttaaaaaatctacagatttttaaatctgtagatttaaaaataaaataaaatacaagtactgctctaagtagttgccatcatttaaaactctggagaattcacctaaaatgctagagttccaaattcttctgatttggaagcactgggcctctatgcccgccctgaaactattagttgagttgcatggtggttgcccccacagcttcctatttcatgctactcgcctgttaactgatatttgttacctgcctgactctgttgactttggctttggatcttctgatccatagtcatcaaactccttgagggcagtagtcatatctcttgagctacagcagcacctaggattggctccttactcctgtttcacctgagtcgctcaactatgtgcactatgtgtatttcatgggctcaggtatctaaagtgacttgactgtggtcccacagcacacactgctgagacagggagagaactgggctcgtggagctggaggcccttggaaattatctagctgctgcagatcatcagaatctagttgagtaagtaagcctttgggcaaaaatccacctcaaattagtttcctcagcaaataccatgctataatttgaatgttggtgtcttccaaaattcatgctggaacctaatgcccagtgtaatagtattaagaggtggggccttttgggaagtgactaagtgatgaggatccaccctcatgaatgggattagtgtccttataaaagagacctgatggggggcttccttgcccttctgccatgtgagaatgcagtgagaaggcaccatctttcaggcagagagcaaacccttattggataccaaacccttattggatactagcaccttgatgtaggacttcccagcctccagaactgtgagcagtgcatttctgttgtttataaattacccagccagaggcattgtgttatagcagcccgaatggtctaggaaaggctgtatctgggttttggaatcagaccgtatgtgctcaatcttggctccacagagctgtgtgacattggacaagttatttcacctctgcatctgattttcttcctttttataatgaagataaacagtatttatctcatagacttgtgtgcagattgaatgacgtaacacataaacacatttcctacagcacttggctcatagttttacttaaaagtcttccctattattatatcctctgaagctgaacaaatcaaatgaaaaaatatatatagttattacaggccatttaaagttcttctatatgaaaatattttaataagacgtggacataaatctctaccattaatctctattttaaaattataccattagaggccgggtgcggtggctcatgcctataatcccagcactttgggaggtcgaggtggatggatcacttgaggtcagaagttcaagaccagcctggccaacatggtgaaaccctgtctctactaaaaatacaaaaaattagccagttgtggtggcacgcacctgtagtcccagctactcgggagtctgaggtgggagaattgcttgaacccaggaggtggaggttgcagtgagccaagatcatgccactgcactccagcctgggtaacagagcaagactctatctcaaaataaaataaaataaacagaattatactattagaaataaacaaagtaaaaggaaaggcagtgacaatctatgttattctggatccacaacatgccagaactggagggaatctaaacctatcctaatggatttaaaacttattttagcagcagaaaccatttcttttaatgtggtcttacatacatgccattcacgagagagatgttgcagctcaggttaggtgaagtccctgaactaggttccagcttcacccagcaaattatagaacctgtgtgctaagggccacagtttggtaactgctgatcttggctatgcctttttatttttaccagtgggaaaagtaagacctttcatatgcctgcacatagaagcaggctcacactgaggaccaagcctggcctatcactgtatcctcagcacccagccatgttcctggaacgtagcgccctggtgatactggggtttgcataatgggtgccatagcacaggtgaggtgccaggcttctgaagtgcagtcttgggggatggacttctagggtagggtggtgatcgctgccagcagggggtaacaaaaacaccattaggtctagccaaggtgttgcgtgtaggatggattctgggagaaggtatagggtggaggtaagcaagtataagcttactgacttacccagagcaactgccagtcctacaagctccattcatggcaaatgccctaggcaggtgtaccattttttatctttcacactgtatttttactgtactgtttctacatttagatacacaaatacttaccattatgttacagttgcctacagtattcattatagtaacatgctgtacaggtttatagcctaggagcaataggctataccacatagcctaggtgtgtagtagctacaccatctatttttatgtaagtatactctatgatcttcacattatggcaaagttgcctaaagacacatttctcagaatgtattcccatcattatgtgacacatgactgtacttctgtagaaagaccaggtttctggagtggtggagtggtggagggcaagttactgtgaattgaaagggaagtgagaaagtgtagatagttggctagactggcttctttcaaggaaggggaggaagaagaaaccacactgaggtaataggagttttcacggagtcagatttcttaagcaatgagcactttggagaggtagcagacttgtgctgtaggatgtagaaaatgggaaaagaaagagaaatgcagaggtcaaagaaaaacatcaccagtttaaaaatgttggtctctgtggtggtttaaaaatattttaaaattatttaacatatgaagaattatttaacatttctctcttcaagaaatatggccaggcctggtggctcacacctgtaatcccagcactttgggaggctgaggcaggaggatcacttgagttcaggagttccagaccagcctggccaacatggtgaaaccccatctctactaaaaataaaaaaattatccgggcatagtagcatgcacctctcattccagctgctctggaggctgaggcaggagaatcgcttgaaccagggaggtggaggttgcagtgagccgagatcatgccactgcactccagtgtgggtgacagagcaagactccatctcaaaataaaaaaaaaaaaagaaagaaagaaatagaccttaattttcctttagtgtgggctggacttagtaacctacttctaatgaatggaaagtgggaagaaggttgggttatcacttctgactctagtctgtagaagatacatggtgatttccatcttggttgccctctctgatatcagggcattctgggagtagccagcagaaacctaacgtttcaaatgaaaggtgtttgtctctgagaagcggacaattaggcctagacttgcaggatgagcaggacttaagctgaggacatggaagccaaaggagttgtacatacaatggcctgggggtgagaggacatggcccattcaaagaactctgggaagttccctatggagctatctgcatatctctttcttcttccagatctgcctccaggcattattcttgtctattggtccatttacacttagatgcacaatgtaataggactctattagcaccaacatcttggaattaatactaattagtattatgttccagtaccacattatagcttaactggctttgctggtggtttgtatatctgacctttatgtataaaattgtttcataggaggaagtgctcctgagaccacacaagtgaccacacaagtccctaggctaggtactgcctgtaacctgccttatcttcatgcctttattgtggtgggacaggtgggtggtgggagaaaatataatgttatgtttcaataaataaaaccttccttcattcaaaccccaagttaatactcgcttgacatttttggagccaaagaatctaatcttatctggccgggaaatttaaactagtctagaccacacatagcagccaaaatttggcaggcttatatatgggcatcaagccatactgactatttacattttcatgtaaatgctcatgaagacgaattaatccctgctgtgactgacatcctgcagcaatttccaacactgcagagaacattaaaaaaataaaaaagtacaattactatttggtgtctctgaccaacagctcccctaagatactgagcagcttcctgaggtggaggttctgatgggaaatctagggagaaatgttgagcagaaggtactgagttttatttattcctatcaataaagtaggagagaagtggcttagcaaagagaagcaaccatactagggggcttaaacaatgaacggaaatgcctcatgtggcagcatggagacaatgtgaacacatctggcagctctttgtggagggagtggttgttaagagtgggttataaaaagtagctcttgaaggtagagcctctggctcagtggtgtctgagagaatgtcccacaatgatgaaaatgttcagtatctgtgatatccaatacaatagccactagacatgtggcttttgagcacttaacatgtggctagtaaggctaagaaactaatttttaatttaatgttaatctcagtagtcacaagtggttggaaaagccttttcaagtataaagtttgatttttctgattagaaaagtgacacatgtttgtgacagaaaacttagaaagccccaaaaagtatataccaaaaaaaaaaaaaaaaaagcattatctatagtaataccaagagagaaccactgttggcactttttgctctatttcctttatcatctgtggacatatgattagtgattttccagtacagttttgtatcctgcttttattacttaatattatatgctagcaattttcccatgagagacatcttcaactataattgatcatattttaggccctgaaacaaatcagaccacatctcatctctgaccaaattagaaacaaagagaaaccctaaaacaaaaatgaaccacccaacaccctataaactagaagcaaaagttctctggacatcaacaagggatgaataaataggactggcagagacatgtggctatttttgccacatccccagttacccagcataaggcaattcattggaaataatcatgtttctttgctatttttccaattgacactttagaatacatctgccaagtctcctaaaatgatatctggcaggccctcccactaatctctgagcctttgcattatcctgaacaaccaccaacagccgatgccaccctggacacacatatacttgtcatctgaactggcaaagccccatgaatgcacactccagctactcttggcaacatgtacaccccctctgcccctctgctgccatggtgggctttttttttttttttttttaagacgaagtctcgctgttgtgccccaggctggagtgtgatggcacgatctcggctcactgcaacctccgcctcctgggttcaagcaattctcctgcctcagcctcctgagtagctgggattatgggcacctgacaccacgcctggctaatttttgtatttttagtagagatggggtttcaccattttggccaggctggtctggaactcctgacctcaggtgatccacccgcctaggcctcccaaagtgttgggattacaggcgtgagccaccacgcctggcccacagtgggctttaatccatgaagggctctctaagcaaagagaaacggttgtcttggatgaaagatgacagggctgctgacacatcatatcagtagtaatcccagtaggtcagtaatcttagtagtgacccatcagtaatctctgtaggtcaggctgggaggattctagggatgatgtcttttacaggtggggaaactgaggctcagagccattacatgccttgccccatgtggtaactaatgtggtagcataatagtggaaatgccattgtaaaggccaaactgtcagcttcacaggctgcagctctttcttctataatggctgagtccacatcaagccttctggctgaaggccaaggaagccgcctgacaagaagcaacccagaggcctctgtacagatgatgtttcaaaagaaaaggtcctttcaaaagccccacaatggctcttcattgctggctactttagggagtagctctggctcatgcgagaggttctgcttcttttcacagtcctgacttgatcttaccattgcaggccaaccttggctgctgcactcacccaagcaactctgagagaagtgtatgtgtggcctggctacctcttagggcaacatgaggtcagtgtattctggggcctggataggcttgtggctgggcctttatgagacaaggctttccaaatctttggtcttcaaattgttctaaaaagcacccgtttttagaggatagttttggtggtagagcctaccataaatctcaatcattagccaagaggcacctacacactgggggtgggacatgcactttggtgtgacaaaatggcagtgataagggatggagaggaatgtggttcagatgttgagaaactgcccatcacatctgctggaaataatagtaacaagtctggccaggtaccatctgtaatcccagcactttgggaggtcaaggcagaaggatcacttgagctcaggagttccagaccagcctgggaaacgtagtgagaccctgtctctacaaaaaatttaaaaattagccaggtgtggtgacatgtgtttgtagccccagctacttaggaggctgaggtgggaggatcacttgagcccaggaggctagaggatgcagtgagccatgatcacaccagcctgggtgacagagtgagaccctgtctcaaaaaaaaaaaaaaaaaaaagtaacaagtgtgaggagatgaaataatatatgtcaagaggaactaacagattatctggaactgaagaaatgaagttattaattatttcttgaaaatgcttgtgcgtcatgcacatggtaagaattccacgaaggggtgtctgtcatatgatgatgtgggaggatgaggagcaacaatgaaaaggactgcacttcctgtgtgtgtgtgaagccctcccatatggagtttcacttccttcccacctccctctccatgcggcagtggtggctgtgtggtttgaggccagggtggaggcatgaggaaaatagaaaaatctagagacacatcacatcacaaagatgagcagtgctgcccagagtgtgttccatggatcatgatatctctaagatgtcaatgagtgatagcaaaagaaaaaagtccagtagccaaatgcagttaaattgggcgggctacacaaaattgaacaagtttctttactggataccttctcaaaggctttgatatgctattgtacactgtaaatcttcaagggtggagacgatgtagtattttgtaaactcatttgaccacagaaggaagtctgttttcactgaccatcactcaggactggcattttgaggagctctcttggcaaacactgatcttcagatttttctcctttttgctttacttccccaccccactgagctaactcccaatcctagaggagaagagatgaagtgctaaaaatggtaattctcacatttgagggtaattgtcatctagggtcttttccctcaacgtgtggtctgggaaccagcagcatcgatatcatctgggagcaaaatgaacattctcgagtctcctcctctcagatgtactgaatcagaacttgcatttcagcaagatccctggtgattcacatgcacattaaagtttgagatgcagactgagggtgcttggtactaggcactaatcttaataattctgatttagtgtatctggggtgaggcccaagaatgtacttatgaagtacttcctccaggagattctgatgcacgtgtgtgtgtgtggactcctgagaaacccctatggtccaagcaccctgctataaggtaacagaacagctctgtggtaacattggttttcacagcagcagctctacaaggtaggtggtggtataatcactttcattgttagaaacaagaaaatggagccttggagagagaatgagaaggtcctggaccaaggtcacccaggggttagcaggtgcattagggtaaacaagtcccctcctgtctgtcctccccacctcacgaatctctgtcctccccctgccctaatcagctcttcattcacaactactgcattgctaacagccctctctgagtctgcttttgttttcagtgaaaggccaacaaaacactgcgggctattcgtgcttgctaatgataattctgattagcttaattgtgtcagctgactccctggcagccaagggccaacagcagcctgcttattcaatcagggcctggcccattttctaattatcagcatcatttgggctgtttcctccaacaaggaacttgcttcagttcaagttatcttcagctgttgcatttacatgagcaatggatgatctgtcacgtctgtgtctgtgtcagtgtgccaggctccccctccctgctggagaccaagtgaaatggcatgtgtttgcctgggttcccaggctgccagccatagcggctgaacagcaggtcccaatgggagccatgaggcaagctctgggggtggatggatgtgctggtcttcaccaggctagccagggtgacctcttcccagcttctgaattccaaactgtattcccactcagaggcctgatagggtgaccaaccgtcctagtttgacagacaccaagagttttcctaggacatgagaatttcactgctaaaacagagagggttggttatcctttgcctgacacaccagggcacaaaagcagtgtgagaggattcaagatttcctgggtgatctatctggaatttggaacagagaatgactaagagttgaggcctcgtctttctctgtgagacctaaagcttatgatgcatccctgctctctgtcttattttgcttttaatgtctattgctaatctgacaggatgaagcattagtcccaacatggaaatgggtaagtggaggtctgcatgcatgttctgagataaggggcgtattgaagagagtgaccagtgtgtaatccctttgaatggaggtgcatcatccttaaagtactctccccaattcaaaaacatattaagcatttattaggtaccaggaaccctaagcaatgcaggaatatgtcctttatattcccagccctcaaagagttgacaatcccatgggagtgactgatacaaatacaattaactacatttgctaggagtctacctagggaatcaatcgttaagacagaaaagaggtcatgggagctagggaagacagaattcaggaacatccactaactacagcccagctactgttacagtcattgtctcacttagctaacatttcttaagcacttccacgtgactaacccatttaatttttataactcttattattatacccatgctatggatgaggaaaatgaagctttgaaaagccatatatcttgctcaagtttgcacgttagtaaatgcagggtccagggttggaacccacagagtctaagacttttcttaggcactgtatgatactgactctcctaccccagtagggtgctgcatggatcctcagcacaacctgtgtggtagatactcagtccacgtgagacaaaagcaacaaagagatgtgtggctgtgcatggtggaggcaaggcagagggaaagatgaggtggtgggggggtctcagagttccatactgtggaatcccaaggcatgacaccaagaatgtcccaccggtggcgtgggaactctgggaatgccaatgttctaagggaaactggctggacaaatgctgcccttctggccccagctgcattcaattctaaaaaatgtacaactagaatgtgaagccaaatgcctgactccttcatcatcctttgagggtcaaaaatgggtgacatttattattttatatttttcagactgtattgtaaatttcttgagagcatagtttttttctttttcttctttttttttttttttgagacggagtctcgctcttttgcccaggccggactgcagtggcgtgatctcggctcactgcaagctctgcctcccgggttcacgccattctcctgcctcagcctcccgagtggctgggactacaggcacccgccaccgtgcctggctaatttttttttgtatttttcgtagagacggggtttcaccgtgttagccaggatggtctcgatctcctgacctcgtgatctgcctgcctcgagagcatagattttttatgcacatagaatatctgagcaacttgagttgtatatatagagtatcaatatatgcaaatcaaataaaaatgtgttgacttgacatgttatgcctgatttgaataggtgcattgcaacagtattagcagttaggcatcctagcactgtcaactgttgaaatggtcatttcggcaatagcaatccacaagccataaacaatctactcttaatggacactgcatgtgctaagtatccagagcctgatattatatgattcgcctcagaaacattcttaatatctatttctgttcctttatagggtttggttagtgtaaaacaaatatatatgttcagacaattaagcatttaaaaagtatgaatatttacaagcattaaaatgaatttccctataattataattaacacataaatgtaggaagtatactattgcaagcaagatttaaagaaatataaacttctggggaaaaaaacctggtacctttcttgctcaattaaactgttaaaaatgtctggttaacctaattttctcccaggcccccaaagaggcccttgtctaggatattgacatgtttgaggccattctgtgactctgagacttcaagttagttcctggcactgccttggagccctttcttcaattatagaaaataactgagttttctgatagcaaagaaagcctttctctacttgataacttacactcagctttttcctacaatgttgtctttatgctttcaggcataaaggagaaattgactttcagctctgtcgtggtgtttctgatcccttagctctgtgaaaccaaaagtgtgagtgcttccacagcctcttccttcttgtgggcctttggagaagttattttccattgacctgaacatgactatagaagagaactgaactgaaaccatccaggagattgcagtggtttcttctgggtcttcatttacgtggcccttgtccatctttcctctctgtccttgacattttctgaaattaactttatcaattgtttctagtcttaactcccttgagctgtttgcacaaccttatcttcccatagtggctgtttacccaaaacagcctttataaaactcagccatcgatgaattctttccatactatttgtccaactgcattcagagacaactcggttcctgcccctgagagccttctagaaatctcttgtgaaagaaaatgaagaaaataggctctttttaaagtaaagatgtgagccatctcaagtgtaacccaaaaagtcttgctttgttccaggactactgagtaatgcaaatatatatatatatatatatatatgtgtttttttttttgccatatattctcacagcagaataataaatttcaaggtgaaaaacactaaaggtgatatgtgaaattcaccatcttctttgccaggtacaggtactgtactgtattaaacatatcttttattttttgtgtttcgattctctaacatcaaaggggccttgttgatcctggagggactgcccctcccagagctagccaattcctagtgatggtaaacaatttgcgctcaagctgtttacacaacaaccaatacaaaccaatcctgcagagcctgcaccccaaatacctcctccatcagggtctcacactaaccaccccaggccaaggtatcagataactaggaataacccctaggctccagagattattcaaattagccaaccctaaacctgcttaccctgtctggccctttccttcccatgaaaaccatggtgaaggttcttgctcaagctttctctgctccctcagtctccggactaacctggggctttcccatgtgctctcttgtggcgtggcatggctctttctcttgggatgagtataacaaattctcttttcaatgacaatcatctgatctgttagctttaccatacctaaataataataaaacctggccaggcatggtggctcacacctgtaatcccagcactttgggagaacaagggtggagaattgcttgaagccagcagtttgagacaagcctagtcaacataatgagatcccatcgctacaaaaaaaaaaaaaaaaaaaaaaaaaaaaaaaaatagccatgccaggctatagtcccagctacttgggaggctgaggtgggaggagtgcttgaacctaggagttgaaggtgagctatggttagctatgatcttgccattgcactccagactgggagacagagtgagaccctgtctcaaagaaaaaataaaaataataaaacctgtgttttaaaataggtacataaagagaaagggataaagggtggcaaaagaggacagcctggccctagtactctggtcattcaaatgaacttggatgaaatgtagttgctctgtcagttatatttagcaaaacagtcaccttgtattatatggggtataatatagtactcaacagagccactataaaaagctttgatcaaagtgtccacattgagatgttgcatgttacaaaaggtgatgaggtttttaggggtccttgacttctgaagcacagattgagtgccactggaaagagagcttttgaagaaaataaaagtagtccccattcacctaaacaataacactaaggatttaatcatatcaaatgttctctattctaatatatcccattgaagctgcatcatggaaaactcaatgtgaaaagcaaagtccctatgagactgtatccttatttagggcttaacttctgtcactacctctggagtaaaagctgcccaaaggcagttttacctgactgtatccctagcagctggcacacagtaggtgctaaatatttatttactgactgaagaaatgtttctgataatctttgattaacagagtgagagataatataaaatatcaaagatgcccatttaaggaattcaataagtggaagaatgactttggaattgaaagttaaagctactccctctgatccaaactattatattcccacaacattctgccacctcttggagggtaatctcggacacttatttggtgacagtggacatcttggcatctcctggctgttagttgaccactaaaccccattcaattctgcagccctcaggctaacagctagccatcaatgagcattttccagggattgacaatgcgctctgacaaatggccgagctcctggggtgacttggataccattatttcatggtgtcacttaccaaaggctctagctccttgcggtctatgaggttcatctctgtgacaaagtaatagaagtgtttgtagcaggtgttgacatgggcctctgcacccatcacaatgacccggtcgaagtggtggatatagacgtggacaaagacccggaaaaggcggcacaggatcttcttgcagatctgaaggaagttctttgggaagggaacacctagagaagaaaaaaagaagaaagaatgaaaccatgatgggatagatccttttcctctttcctctaatatgaaaactgtctgagggcaatgctacagggagactggcacccgtcacaggagtcatagggagtgtgtgtgtgtggggggggggggttggtagcaaactagaaagcaccttccacctccccatcaaagggagcagttgctgcgactacagccaacagtggccatatagggatggaggcccagtgttgttagagcttctaatttttcaagataattcagaaatttagagttatacttggacctgctgcattttttaaacattagcaattaacttgaagttttaaaaagtaccatgagtcaaaataaaacatctctataagttacactgggcctgcaagctaccagtctgcaaagcttttcctgaggtatactgtttctgaggtgggcaaattcaataactttcacagatactttgcatcacagattcccccttcgtctctttgaggaaggtaagagttgggaggaggtcttgtttttcataacacagaaagggtgagtggtcatcgaagtcactcagatttcccgtctgatgaccactactcccagctcagtaaagcaacaaattgcaggatcgcaagcccacgtcctttctccatctcaaacactgcttaagctgttttgttatttgcactgtccttaagtggtgacatgttgtaatgggttcctaagctaaacagacattgtttgaattcttactctgctccccttccagctgtatgactgtgggcaagttgtttgacttttggtttctcatctgtaaaagagcggtcataataaggtcttccttaaatggctgggaaggtattaatgtaagatcctcctacagcgcctagaacatagtgaaagcttattaaattgataatgtcctcccttttctctacaaggtaaggtctgttgttataaggaaaagaattacccggccagatgcggtggctcacacctgtaattccagcactttgggaggctgaggcaggcagattgcctgaggtcaggagtttgagaccagtctggccaacatggtgaaacactatctctactaaaaatacaaaaaaattagccgggcatgtggcgtgcgcctgtaatcccagctactcaggaggctgagccaggggaattgcttgaacctgggaggtggaggttgcagtgagccaagattgcgccactgcactccagccttggcgacagagtgagactccgtctcaaacaaacaaacaaacaaaaccaacaacaacaaaagaattacccttgtcaaagaaaggtagaaatgaccactagcctttcagcaaaattgtagaactatgcacggcacatgccccaagtccccaggaagcctggagttttgctgtccttccctccacagaaacctagcagcagctgtctggtgagacactgtaatgggatcacctgggaccccagggcaggatgagaaggaacatgtctggcaggcggcagtgacaagatctgcttcccttgggtcccaacactgataatggcttttctttgaaacaaagtggcaacatatcaaatgaacccagggagaagttctggcactgcttgggagctgactgcctgggcaacagatgctgggatttggggttgagggtgcggtagagccaaggagaaggtggagggcagccacatgcagagtttatgggctgctttctcagtggagaggggcctgcagaactgctgttgccacactgggggcgggtctggagtctttgaagcctgagtcccagaagtgatgaaattccctctaagataggtatgtttccttcacatggggagtcctgtaacccacctggtgacaatgccaggaggtcgacatatgttgtcttcacaatgtatctgtggaataggttttattattcctattaatgtttcatagataaatagcactgaagctcttcagcatgaattctgttgctaaaaagtggtagggctgggatttgaaccaagtccgcctgactctaaaatccaaaaaatgagtattacagagtacaacgctctctcttcccaggttagaggaaccactcgattgtcaagcacagtgaggcatctaaaagttactcttcagtggcacagagacataaataagcaaaagaaaggggatggggacagaagaaggagaaggacagaaaaatgtccacagcatcagaagccacaaccagaggcaagaagaggtcagctaacatactctgctgccttcaacgagagtatgttagctttctctgcccaggccttaagaccacagacctgggattaacagtaaaaagtagtatttactgagctcttactatgttctaggaactgtgccaagccctatctatagattagctaactgagccctcagaacaggccttaaattacttccatctcacagataaagaaatagatttgggacaattaagtagctgcccaaggtcacccagcggggaaatagtagaggagagatttagccagttagtctgactccaaagtccacgagcactgctcacgggctctgcacacacttttagctctgaagcccttcctttctgggcagctcaaactccctcaagtgtgctcccacttctcctcccctggttccagtctcatggaagctcaccagatgctgggggacacagggactttcagctgtgccagtttatctgtgtggcccttatagccagcccccctaccctccacactggctacagataaggcaaagttttggacacactgcggatgctcatggcaattgctggccccttttagactgtctccaagcggctctgttccccccatctctgccactgctcagctcagaaatctcagctgtgccttccattccatacctggtctctgacttgtctctggccttgaagggggtttgcctcttgcctatccattttgggctatggctttagagtagttggttttgcaatctggaagacctagtttaaaatactaacctgacttcttactagctacagcttatgtagcctatgtagctagtaagcagtagggctaggattttaaactaggtctttagtttaaaatccagtcgagtcttcatcactcaactttattataaaactaatacacaaatttactttgtagtgtttttattagtatctgtactgtgcttggcactcaatggaactttgggagtaagttcaactttcattatttcccacctgaactcctcgggtaggtaggactccaggctcagaatctcttggctctggctgctaagtcaggccccactcttccaccattccctccctcccatgtaattcattcttcaaaagcaaaagctgcaaacggttcaagttgagacatgttcagcatgcactgcagtcaccccaggccaactccagacactgcaaagaggttgggagccctcaggagcctaggaaaccccactgggttctctgctgagtcaaagacaaaatccagctcacagagagtgggaaaagaacaggaaagctacatgcatttgaaaaattcttatatttattgatggttcagaggccaattctacagtttgcatactattttcacccttttcccttctgccttacagacgtccagatttgtgtgtgtgttttaaataaacctcagaaggtgggacttggaagaggttatcccttcagatggcgagacctcggatgtccaccccttctgcagactctggaactttctcattctatgtaactaacctcatggcagcaagatagaacaagatacagcttgctgacccactccctttcctggcaggctccagagagccagttcatgaaaactgattgatttgaggtggttttctttcttcatggtgctgcaaagaagtatccaatctccattacataactaaaagaaaagggaattccaaatgagggctgatctgtgtatgtgcaatgtcatttaattccagtgacaccctgagtagtggaattattatttcaggtttttcgtttttttgtttgtttgtttttgtgtttttttgagatggagtctcgcactttcgcccagtacagtggcaggatcgtggctcactgcaagctccgcctcccaggttcatgccattctcctgcctcagcctcccaagtagctgggactacaggcgcccgccgccacgcccggctaattttttgtatttttagtagagacggggtttcactgtgttagccaggatggtctcgatctcctgacctcgtgatctgcccacctcagcctcccaaagtgctgggattataggcgtgatccaccacgcccggctcagttttttttttttttaaatggaaactgaggcttagctcagttaaatcatttgccccaggccacaagggtaaaaggagatagagatttggcttcaaaactcaggctctttcttcagcatcctataggttctatggtgtcagggaaggtgagggacaagaataccattttattttaatttattcattgtttaaggacagggttttactctgtcacccaggctggagtgcagtgtcacaatcacagctcactgcagcctcagcctcctgggcccaagcaatcctcctgcctcagccttccaagtagctgagaatacaggcatgcgccaccatgcctggctaacttttgtaaatgtttttgtggagacaaggtcccactatgttgcccagcctggtctcaagctcctgggctcaagcgatcctcccacctcagcctctcaacatgctgggattacacgtgtgagctatcttgtccagccaaaaacaccattttatgacctgcacttagcttgcttgtggaaggagctcaaaaaatgtttgttttaaaagaatccagctcagcaattggaagaagaaaggcaactggatcacctcgaacggacacttggctagctacaatggcatcctggacctggggagctgtgcatggctgggtctgagcaaagggcaacccgtgttctacatggcacaagtgacccaacatcaggaccataaccaatgccctccttctgcctcatgagtacataagacacgatagaccctccacttcagtattccccattatgtgttttaaaaatcactattcttgagagatccttggctaaaaagagaggattctgagaccaaatatattggcaaaaatgctgttttcatagaggtttacaacgtacccaagcatagtaaaggatctgagaatatctgtagcaaaaaatcctatttaaatctggattcccctttgcttataatagctattgatttaaaacacagagtctgtaaccagaactcctaggctttatttctacctttaccacttattcacaatgtagccatatgcagatgatgtagtgtctccaagcctcactttccccttaaagaatatatcccttaaagaaaaatggggatatattaatgttatttgtagcttagggtgttgtgcagattaattacataaacatctaaaaggtttagcttactgccttgcagtattctattgtgaattgttagttttagtatcccattgaccaaatggtctttgtgacaaactttgggattaaattcctggctatttattttcatgatagcagtcttggcattaatacatcaattctggacttgcaaaaaacttacagtggcaggtactaaataagccctggagtataatctaccttgcattattttctactagtttctcaaacttatgtcttatattgctgtaagttctctgaacaaagggactgtgttatactttgattccacctttgaaagcacctggcacaggcaaggcagggaatacttcatcgatcaaaattgaatcagaaaagagcagtggtcttatttagtcaagatgtgaatccatcatctcctgtttgggggaggcaaaaaaaaaaaaagaaaacccacagcagaaaggatagctttttgccagactcctgatatatatagtcctggcatggaaggctgcatgttgcttttggggagaagagaaaactttgcaatgaggaacactgtgatccagcctagggtgtggaaaggaaaaactctgaaactttctttttatcattgaaatcttccttcttctctttttttttttttttttttcaggtagtgagagttaattttcagtcactgtactcagaaagttaatgccagacaacattaaccagcagtcctaactgaaatagattgtatatcttaagggtttggagttagattttgactagtcttataataatccagacaaaccatcagcaataataccagactgttagatatgtgcctgtattgatgatatagaaaacaatctttgattacaagatctctaagtgatttgcaatcaataattgagactcagaacatgcccttctctctatcctaccctgagctaccaccagtggctcttagcttaaaagctggaaaatttcagactccaagaagttggcccacattgagaaagtgttcagactagtgctccacagagaggggatggatatccaggtgtccaaggataaccctggacctggatggccttgggtcatgtgatgtagcttagtttctgcaaacggaccagtactgaaatggagttaatgagcctgaaacagggccagctgagctcaagttttggagtgcgccgaggcaacatgcctaagcagaggccagaatccaaaccaatcactgatacaagtttctagcaggagtctgctcaccagttagactcaaagcaagactagagttttctgagcaattaggctaaggaggaggcaggccagggtgctggggtgagggtggagagtaaggagagtgcaggcctggagtctctcttgaaggcctgatgagacagccttgtagccctgtctctgttgctcatgaagccttggtactcagtcaggaacccgcatctgacagagccctgctgagtttatgaatgtgtctaaccacaactttctgatctccaagccacattcagtgtgagagctaaatcgagtatgaaacgtaataatttctctgaggccccatgcagatttgcctttcatctctgccttaggaaatctcctttctccccaagaaaatttaataaaaattccagtaatttctgcacttcaacccatttttctttcttcctctttccctcctgcccctcccttccactaagccctcaaacatctcattcaatccttccttttcaggcacctctgaaagaaaataagttgcctaaatggcttgtgttacttattttatcttgttatggaggccaaaaaaggaaaaactcctttagaatatgcagaaatgcttcggttgacgaaggtccaggagactggggggtggggatgtgtgttctgagctggctgttaatcattcctgttttcatcattttcccttttctttggaagagaaaggccaacacctgggaatgagactctgatctgtgatcggtgctgggctgaacctgggcttttgtggtctgaagagtaagaaccaaaaggttgtctctggggatactggagaactgcccccaaacacctcaagttctgcaaacaactggcagataggcccctttattgagcacctggttactgcctcttctttctttagagcttggctcagtgtctcccatcatccgcagacccagcttccctggcatctgttattctgctcctgaaattttcctgcatagatcacacatggtaattccacatgtatctgtgggagtctctgcttcaggtctgttacctgctccagactggccactctgtgagagcagggacggtgtccagcctcctcacaagtgtctccttagtgacgtctccttagtggcctggcacctggagcagggtgggtatggaataaatacttgctgaccgttggaatgagagctgagctcctgtgccgcctgcataccctgaaatcaaagctcaaagaggtgaagggacagacttgggctttatagagctagtttgtgatgaagagggatctgaattcaagtctgtctcagagcctatgctccttctattctgccaggaagctttgtagggtttctacagctcctttcatctcatgcaaatacgattgacacagctggggaaacgaaacttgttagaagacaaggtggaaaagggtagtttggcttttactttcccaaatgtatgtgtcactgggggtttaggacactggtgaaacgcctggctctggcctcaatcccatttatgattccagctgtgggacttctgtgctgcttgcccttaagcaactttgctaactgccaaaagcctctgttttcttgtctgaggaatggtgataataatacctagctcttcatgagaccacaaggactaaatgagaagcacagcaccagcaggcacacagaaggcatctggcaaatggcagccgatgttaccaacgctaggaagacggctcttctgaatcaatgccaagacaggggtggcaggagggcaaatgaaacaggacaggtgaagctgcctcttctccaaaggataaactcttcttggaaagtatacttggaagacatgtcatatattggaagagcatgtgaactgtccaaggagcttccaaaggacatatgatgaaacctgatttcctggccaatcctttgggacccctgatggcatgtcaacaacaaccagaagtgcccatgtttctccttgaaactgttattcatgtctgagggcatttgtgctgtcccttctgtcttcagagtccagtaataagagggatgtgaaaatccctctacaagtcataaaaaccactcattctcaatagttcatgaataaaaacaacatcccacacacgtggaaaaagaaaacatacctcctctggcagcgtggctgagaacacaccatttccaaaatacttgcaaaacaagatgcaatcggatcacaaggcaaaaacaaaacaaaacaaaacaaaacacatgaacaacacagatgtttcttaataatatatatcctcctcctcttagcttattctcttgccccttcatccatccattctcctgcctcctgctctctgtctatatatatacatacatatacatatatatacacacacatacatacacacacacacacacacacacacacacacacatacagagagggagagagagagaagcttcgtgttcttgctgatgctgatgaaaattcagctgcgaggattgattcctcttagcagatgttttgtgttatctcagtacgttcctcaagaaagtgtctgttcgtcatgccaaggaaaacaatcctgtgtagcaggactttgttcctctgcctaaaaaaagagaaaacaaagtccccaaacaagctgacagctgcaaatgcttagaaataaactggctactactctgttttccaactccctccctctgcccctccccagcccctttgtgctgtcctccagtctgttatcatggtggttgggccaaaagaaagacaaacagtggtatgtgattatatgttctcaagagagtcttaattctttcagacatgccatgtgctgggcataggaagtgctgtttcagccaccccaaggagcaaccatgagtccagcgtgcctgctcgtcacacctcctcctacccctgagcgccacttctgagttgctcatcagcatccccagctcccagatggctgcctttgtcccctgctttcacagcatggatgtgaaaggagcagtagattaagaaagacccaagataacccgtgaaagatattcactgtggattgacaataaaagccattagaaacaaaccctagaccgtgtaaacctgaccagtttgctgaaaatcaaatgggacaaatgagccagagctgagaacaggatgttaatgaacttcattggttctggaaagtcaggctgaggtaccaggagtttgatcaggaatataggtctaggactaccacaccttctggtttttttcatgagccccaaccagaatttgaaagccaggttctttgtcatggatgtaatattgtgagtatcctcacaaataaaactattctttattccccagtagaatctttcttccattatgtggggacaattaacaccaagtcttgtcttgaacagttgctgatctctaaatttctcttcagccccactgcctccttcctagctcacctcctgcctagtttatgcaggtcccttgtaactaagcttcctttctttactcctgcatttcttcaatctccacttggcaggtgaaggaccttcccaatacgcaaatctaaccaggaagcctgtttttctgcataaaactctaaagcagcctcctactgcttccaaggtgaaatcaaagctatttaacatgcaggcaagaccctttatgatttcacacatgcagtggtccaccatcatttctggattctcccaacttgcatgtaatactccagccatctgaagctacgatcctctttctcacttgcttctgggcgttgctacatactggagggttggtagctggaaacctcttcctcagcttctccatttcgcctgactaactcccatttgttattcaaaccttaactaatttgtcacttcctctagaacgtcctccctggccacctcaccctcagtctaggtaggcatatcataacacccgctgcttcttccatgacaatactaccacatcaacttttaattgtcctttttttttttttttttttgtctcccaggagactgaaaattgtgtaatgtcagggatctttcttgttcatagtcatagccctggcatcgaatgcatagcagaacacggtggttctccatatgtaattattgaatgcaacggattgaatgcttatgcccccctcaaatgcacgtgttgaaatcctaattcccaggctgatggtactaggaggtggggcctttgggaggtgattaggtcatgaaggcagacaccccatgaatgggattagtgcctttaaaaaggagggtcctggctgggcgcggtcgctcaggcctgtaatcccagcactttgggaggctaaggtgggcagatcacctgaggtcgggaattcaagaccggcctgaccaacatggagaaaccccgtctgtactaaaaatacaaaattagccgggcatggtggtgcatgcttgtaatcccagctactagggaggctgaggcaggagaatcacttgaacttggaaggcagaggttgcggtgagccaatattgtaccattgcactccagactgggcaacaagagtgaaactccatctcagaaaaaaaaaaaagaaaaaaagagggtcctttttctttctccatgtgaagttatagcaaaaactgccatctgtgaaacaggaagcaaggcctcaccagacactgaacccaccagacactgaatctgtcagtgccttgatcttggacttcccagcctcctgaactgtgagaaataaacatttgttgtttataagccactctgtttgtggtatttttgttgtagcagcttgaatggactaggccagtgaataaacaaataaccatagaaacctgagttgtgcgggagtggtgaagagcttcccctgcttgggttccccttacttttcccaactccaagcactggcccttgagtcacaatctgaaaaccactgcttggtagaaagatctccatggaattgctataggcccacgtttaaccaagtcacgtctaaggagtaacgctaccgtgaacattaatacacagttatctcttcacaccttgcagatctcggagagaaacgcatctatcagatttttactgataccgaggaagaagtatctccctcttcgaattgtattgtacatttgcattgatgtggttattttcatctaaataaagtcaaacaggtagttttccagagttattaaagtttgcaataagccagatttggttggcaaatcatgctgagacacataatgggaggaggtgggggcaagggagaagatagcaatgtcattgatcctctttgtacagttgggggaacccagaaagaacaattggaacccaacttgagcggggctttgcagagccaaagggaacagtgacccttctgaaatgaacctgagataggaataaaactgttgggggatcttctccagacaaacagaatctgagggaaagacggtgagtggatgctgaggactttttccacctgacatagaggggttaaggcagcactgagcaagaaatggtgagtcattgcatttgcatgtaagatcccgcgaaggtaagttgaagggatagggaagaaaccagaaatgtggctctaaaatcttatctctgggtcaaagtcaagctaaattcatgaactaattcaagtaaattatttacttgaatatgtcttaaacaagatatcacatattcacatgccttcagggattacaaaggaacatgaatgagtaaagtaggctgggtgtaatatgatcgggagtggcgtggactgtgccagcctggagagtgtattatgcaggaaaggaaaaaagcctctcagccttagctgattgttggccagcaggaatatagatctaggactgccagaccttctgttttttttcaagataatccagaaatctagattcttacatgaaacctccccgtggttaaattttagttaattcaaggacactaaaaaattttcaaacgttttatttattaacattatttagtcttatatagctcactcagcctggaagttgactctataagctgacagcttaattttaaaaattcaaatttaaaaattaaaaaagaaggaaagaaaaacactctcgtagcactgagcacatgaaacacatggatcttggtttccaacatcattttttaaataaaggaatcagggccccttggagaaaatggctgattctaggactgaggcaggaaatataaaagatggcctgggacaccttagtgtcagaaagaaaggaagtgctaataaaaacacaatgacaggggcgtaggagccaacctgaaagagctccggaatggcccaaactggaacaatctgagcaaaaaaatagatggagtagttttgcattataacctaaagtagaaaataaatatctgtgagttcacactgatataaataaatggttggatagtaaatagggaaaagaaaaatctcctgtgtagtgagattccaaatatgtaaatactccctgttcaaggagatgaatgaagctcttgagcgtgggctatgcttggtgagttgcttccaaagagtacagtataggtggctttatagtcaagaaacctggcaaacatgaccttgaccaagtgatcaaggttaacatcaacagtgatcaatcgtgttcatagaatatggctttgatacgataagtcgcttcacttctgtggtctccctccccataacccataagccctatctaaccataaaaaaaatcagacaaaccaacactgaagaatgttctacaaaacatctgactggtagtcctcaaaactgtcaagttcatcaaaacaaggaaagtctgaagagcctaaggagatgtgctgactaaatgtaatgtggtatcctggatggaatccaggaacagaaaaagggcattagggaaaaactgaatactgtgtagagtttaataacagtagtgttcatgtgttagttcctcagctgtgacaaatgttttgtgagatgttagcgatactggaaactgggtgagggatatatgggaactctgtactatctttacaactttttaataaaccaactattctaaagaaaatgtttatattaagagtttatttatatttaaaaaacactctgtgggtcaaaaatatttgattggctccagaggccatgagtttgtacgttttgatttacgcactaacatttctgtctttactgttatgctctgatcaggactggctacataatttgcagagccccttgtttagaaattattaagcacttcaagatggcaacagcagagtcttaaaccaagcatggggccattctgagtgcaggtttcatgactgtgaagctggccctgtctctgacatgtgatatgatctgaacagagctgtggagtcaggagtcatccttgccagatacaactcccactatacaccctttgtttgttcattaactaatttaatagctaacaatagcaaatatttatttgtttgcagatgtgctagatactagggattcagcaataagcgaaagagttaaattgaataaggtcatgttatacctaagtttccagcactggaagttgacctaaggacctcccccaggtacagacacccacaaggctcatcccctcaccctctctattttcccactttcttccatctcaactgcaatactacctacctacaatgaaaattctatagaaaaaggatttcttaagttccaaaataaaatacataaaagttttttgtgactattatataatatttgcaatttaaagtctcaattacattggctccgaagagaaacttttatttcctgggcatccaatggcaccagccatgtaaatatccttatcccaaaaaaaaccaacaaactctgcagttgttttccctattttgtggatgaaaaaatactgttaaattgaatttggccaaaagccgcctcctctactttaagtctggtctaaaggtttgtcagtacctaatgaacccaacttgatgagtaaacaggctatatcctactcttgcagcaagtagcctagtcttagccaatcacagtagctgaaccacagacagacatctgtttaaacctggttcaaataaggcaaatgcccagctgtaaccgatccagctgtttctatacgtcacttccgttttctgtactttgctttttctgttgataaatgttatccaaccaaacagcagccctggagtccctttgaacctgttctggttctcagggctgcccaattcatgaataattctttgcttgaataaactccattaatctgtctgaagtattttttttttttttttaaataatgagaaactaagagaggctgcatcacttgcttaagtgatacaggtggtgaagctggatttaaacctagatcccactcactttgaaacagccacttcccaaataatataccctctacccctcaaaaaccaaggcaattcctttaaaattattaacttaatcatccagaaagtaccctcaatggttagtcatggagtttaaaaagtcctcaactgaaataaattactgttagactagtagccaattttaaggtccttatgaaacacaacttttgaggagaactggtcttttggaatttggtcttggtgaggcaggagtgggaagaggagggagaggacagaggtgactaaagcaatggtctctctagaacttgacattcacaagcagagatgagaaactggtgcctgcaggccaaagtcagcccacaggactgtcttctttggactacatatttttaaaatgctaccaatatttagaaactggaaactataacacaaagacgaattcttgcttctcttggaataactcagaagacctggcacaactggactgagattcccacatggcagcagctcagtaatgtctgctccccatacatggaagatgctgtactcatctgaggagccccattcattccatttatttatattgccagctggacccttgagaggaaaagttacctgtgattgcaaatttgattacagcagatggtgggcacttctggctaggtggccttccttgggacaggtgttggccattttagggagcaggggctctgtccaccatggggccaccccagagtggggtccactggcctgccacctgctcctttacattgggccatccatcccagctgttattcaagctctggccaaaccacttttgttttgtaaggccaggtgaggcttggttgcatagaagatgtcttttggccatactggaaaatcattaccctagtaacactgtctttgagtacctcatacttgcagcttctttgttctcccagccccagcaagcactggagtggggtagtcactctttttggttctccgtttaacataaatgtgcagaaggcaccatttacttgttttctgaacggaatcccagggagcatgaacagacagacttctggggatgatgaaggcacatgggcttcatgttttgcaatacaagagttttctccatatgttctttctttattaacattcataggtggtccttgagttacatatgcttaactttcttacctcctgcatatttgcacactacatggacattgctaaattccctttactagggtgcatttgatctatgatacattaattatagtggatgctttggtgatgtcacacagaagcactgtggaggagtgtgtactcgctagaggagaggacaaaagccccacactcaccccatgcatcctgaggagcctctagcaacccctgctgcctaaccccattagaagaaccaccttgcagagcaaaagcccttttgcccagcacaatctccctaggttcctatgatgattctcacatttccaggtcccaaaggcattagcacccattgggaccttaattaacaattgtaagatgctttctaattctctgaaaaaacttctaatctacaaatgcatgctttgtatttcaggcagacattgtagaatgtatttacaagaataggtgactgcctacacaaattcttttggtctaatcataaaagtaatattgtttaaaaattagaaaatgttatcattatcacccataatcccatcaagaaataatcactggtaatattttgttgtgttatcttccagtcttttttctgtgtgtgtatgtatatagttttgttaaaagtacaattagagtcatactaaatattcagtttgtatcctcctttttgtacttgacataagtattagatattctttgaacaatgaatcaccatataaccatcacacagactcagcaattatcaagacaaagtaatacttagatgcctcttcttgtacatatctttgacagttggtcctgacaattttccttggctaaattcttaggagtggactaaatcccatttacattacattttacattaagagttcatgaacactttgcattatactccacaatagatgtttgtttcatagaaaatattgaaatgaaatgaatgagcactatttgtcttgcagtgttggtacccgttgcacacactgagtttcccagaagtatgcatgctgccgttagaaaaaaatggacacaggactcaagaaccaaagctataaaaaggaattagtagtcttcctttgagtatagcagtggttctcaaccctggctgtgcattagaattatccagggaacataaaaaaatagaatggcagtgtctcacactagaacaattgaatctgaagttcctcagatgattctaatgtacagccctggttgagaaatactggcctacagaagtgattctttaagtgtggtctccggaccagcagcaccagcaatatctgggagcttgctagaaatgcaaattcccaggcctcaacctagcagcactgaatctaacacttggggacaagggtccagcaatctgtgctttaagatgtcctccagaaatcttgatccatgacaaattttaagaaccacaggcctagaatattcctggctcaaggatctagcttgcttaaccaagtgggaagtctggctgaagatttacagaatctggtgtctgacttgaactcaagtctctcgtctcccatttattagctacacgatcttgggcaaatgacttagcctctctgaggctgtttcactgtgaaggacataaggatcttaatagcatctaccttgttgggctgttgtgaggattaaagggaaaataatgaatggtattttccaaaaggtagaacttgataaaatttgctattttcattagccatcagagaactattactgtggtcaggagatcaggaaggaagcctccgaggtggagggagacaactgatctgtcagtctgaacacccaaaacagatgtttgtttcctaactcttttccaggcctaggcttggatttagattacacctgctgtgacacaaatacatgaatctcccaggatgagacgatgagtcattctctcaggagctgtcttcacactacggaagtgctgaaaatacacggctagagagccgggcttggtcatctggacctcaaaactgccaggggtgggaggaaggggagaagggaggggaccacccttctaacacctagaccagtgttctcaaacgggagccctgagaagcacctggagtgctcactgaacacagactgctgagctgcacccccagagtttcagtgagtctggggaggggtctgagaacttgtgcttcaaacaagttcccaggtgaggtttatacaaatctgaccacactttttatgctaaattgaaaacactggcaaagttcatgaaactgcaaggcaactgaactgtgacctataaaaagttttaaaaactagcgaaatgttctctaagactttcacatttcctctgtaaaattcaaattccgtttgacattctatttaggtttgccccagagtaacactggccaactttacagaagtgtggatagtgacgttcatttgaaccctaggtcccccacagggggttgaagggcagggtgatgggcaagcccagcctgtcttgctctgctctcacaggtagtggggtaagaaatcattcactgtcacctctccttcccccaagaagccaacacacatcaatcacttagactaagagtttgtatacaccacatcatttaattcttcctgcaatctatgaggtatgggctacttatgtctcaatttttacagatgaaggaactgaaactaagagaggttaaactttctgaagacacatagctagtaataaggatcttcaggtcagaaatcagatctcaaaacctttgcatttctctttctgacctacacaatgagtagaagagtctttgcttctagactgaaaagactgtgtgtgactgagaatgaatctcagctggggagggaatgaggtcataaggatggatgctgcatctggacatgggtaaaaagggacacatattgctgctcacctactctccagcaggctctgatgtcagctctggacaaagtgaacaggaggcaaagctggccctgatcccatctagttccctcaatgatgtggccagaatgattacattcaccactactcctggcgcaagggcaaaagccagggtttagtcccagaactattggaaccagggggcagcttggccaaaggaccgtgaaggtgagggccggggatctggtgtgccagtctgtgttcttcttccccctgtatctcactctatggctttctggtccattctcccagcccttgccagccctgatgactccctgacccagaaccacacctggggaatcctgtgcatctttgagtattgcatgtgcatgggcagagctgggcatgtgaccaaagtgataaaggaaatgaaggtcttatcacacagggaggctaggagaagactggaaggatagggctcaaatatttgaaagaaggtcatttggaagaggaaagggaaaagaaaattgcaaaccacttatccagggccacaaagctaacaagtgctagagtggaattctagcccacgtcttctgagctcaaagctcaaagcttgctctctttccactgctctgttctgcctcctcagggtcagaaggaaccccttcctttaggtcagcatgaagacaaatttacattgcctaaggtgtccaaaatgggatgcattgtctcaggtgatagtgagctccccaggctggaggtgttcaagaagaagcccggagaccacttgcaagggttgttggagcggggattcaggcaagggaagatggttttcatctctggttgcatgttaccatctcctgcattgcttctcagcagagtggattcccagacccccttgtgatttactggctcttgggtgcatctcaggaataggtgacttttaaagcacccttggggattctaacgcacctttaggaattactggggtttccttcaactctgaaattctatgacttgagtttttggcataagagacagctagctgtggggtgacagtgctggtgacaacaatattcgataattactgagggtttactctgaaccaggaccagtcattacctcactgagtcctcaccacaaccacaggaggcaggtactaccatcatcccctgttcacagatgaggaaacgacagaggaagatgaagtttcctgcccaaggtcacaccccaaagtgttggaggagccgggctgtgagggctgcagatcttttctccttaccataggagcagaaggcaccaagtgagacctggtccaaagccattcagtccaaggcaggttctgaacaaaagcccccagtggttaatctcccaaataaaaactacacagtccaggaagcaccaggagagtgaaacagaccctcagatcttgaaaagattataagcactgaaagagttgcaaagctctcaaggcataaagtctaactatttctttggtctaaatatatcatatttggtttttcaaaatgtaaacttttcaatatagtacaaagtgtacctaggtaaatcttactgctattcgctcacctaaaaataaaacaaaacttgttcgttaaaagtgcttccattcagttatagaatattcaaacaaagtgtcattaagtatattgacacaacggttaaaacattaaccccagtgaaactcctgatgtgccagttcagcagaacccacccacgcctttctgggaaaagctggatcaacccctgtatcttgcaagttgtgtctaaatcctcacccaccacgaggtctatgggcccccactagcagtgcaactttagtgcatacccattctccaccaaatatgttttattttccctcttgggaccaatcacaaagttctggggaggggccaagtgcagaaaaagagataggattttttttttttttttttttttagacagaatctcactctgtcgccaggctggagtgcagtggcatgatcttggctcactgcaacctccgcctcagcctcccgagtagctgggactacagacgcccgccatgacacccagctaatttttgtatttttagtagagacaggttttcaccatgttggccaggatggtctcgatctcttgacctcgtgatccacccgcctcggcctcccaaagtgctgggatcacaggtgtgagccaccacgccccgccaagagataggaattccatactataagggctgaagccactgggcattttccaggttgaataaatgccttattcaactaactctcattaacgatgactctgggccaaatggtgggaggagtggaggtggtccagcttctggcccctccccacccccacccttgtaaatcacccttgttcttgctgtagtccagggctcttaagctattcaagctatttcaggatccatcccccacctgcccaccaccccctcatagttcctaacccctcataagagattagttaaaacttataaaagggaattgagacagcctaaatggcatcaaccattcaaagaagatgtctggggctttccacactgcctaaggaagttcaatttaacctgggggtgggatgaggcagagccaactccaccttttcagatctagaaatcatctggggaacatcagttcactacctctcactgggctcatgatctgggtgagctttggaggaacttgtttaacctctctaggtttcaggctcctgagctgacaagacatgcagctgagatcagtatgcctcaaactctactgcaggcatggaggtgctgctgaatggtggaaggagcaaggaatcctgttttcctcttatctatccatagtgggtgtttaagttctcggtagaattacacttgacaaaattaaagtttgaaaaatcctggcctaggtaatttctaaggtgccttctggacctaacattctatggctctgacactctatttcccacaaaaataaatggctgttgcctctcggtgttgcctccccagtccctgctgatctgaggactgctaaagacttaacacatcttccctgaggctggagtcctggggctacaagtctgtctctgccaaaagactgagaagctgcctacattttctgtgcttcttgggaccctgagaaccctgagtggccctggaattctgctaagtgcctatggaaaccaagccagatgtggatagcagagaactgggtgtaacggcaacaccagtcatcgcactctaggctgggccctttgtggcactgcctgattttgtgatggaattaaagatgttttccttacaggtagccctagaacttttttttcgtttaagagacagggtctcactctgttgtccaggctggtgtgcagaggcgccatcgtagctcattgtatcctcaacctcctgggcttaagcaatcctcctgcctcagcctcttgagtagctagaactataagaacgcaccaccacatccagctaaatttttattttatgtagagatgacgtctcgctatgttgcctaggctggtatcaaactacggggttcaagcaatcctccagccttggcatctcaaagcgttaggattacaagtgtgagctaagtctggaaaaagtaacattaaattgatgaggggtggacattaacctgatacgagtgggcattctctagcttcgggccttggagtcagaaagccttgggttcataattctgacatcccctcagtctgctctgtgtctttgagcacattatttcgtctaagtgtcagcttttccatagttcaaatgagcgatgaaatgacatttgtatgtgttgacagcttggcatagtgtcgggcactgtaaatgttattgttattattgccaccactttgtactaggtcaattcctcgacagctttaatatgtgatgagtactgaaaaaagcaaaaaagttaaggggctcaaagacacccagctgtgtggaacaaccactgcttcagatatcagatcgattctctttctacacagccttctctgcctaaagccccaggttccccttaacacactgagtaggatcaactgttcctagttattcctggtgccctgactcactctttcatccagaagctagaaagatgtgtgctgtttagaagatcagggccaatccttctccaacccccttcacccccatggctgagggtggaaaaatgcacctaatcaatccgggcatgttgtgagttccttcaccatgattcagacaaacaggtccgtggctcctacctaggctgagaaaagaccagaccaagaattcagtggaccttgccctcccaaggcataataaaaacccgataaatgtgaacttgcagtaagatatgcctctctggtgtgaaatgagaggtgaaggtgatatatatatatatatatatccatccaggggccacttgctatgttattcactgcagaactggtgctttttgcagttccctgaggggtatgaaactgccagtgcttccctctcccctacccaatccaattaaatccccacttcaaagccccacaataatctcatgaacttccaggacttagtgctatgcggtctttatgtgttaaagatatgaatgatgaaacaaataaaactaacaagcaagaaggtatttgggggagaggagaataaattgattagtaagatcataagagagagtttagcagggaaaagaatgtggggggagaagaaaatgtccatcaatagacacttattgtgtggcagccactgtttagacctgaaggtgagggggttaagagcgtggatctaggactcccagcctacccatgttcacaccctgcttgcacatgatcacttggacaaattatgcaacctctctgtgccttggaggtaataacagaacctcacccacagggctgtcatggcgatgtcaaaaattcatatatatgggagcccttacaacagagcctggtgcataaaaagtggtacagaagaatttgctattattaataaagtttctcatttaatctctccctctcatttctgcctttatgaagtggcagggttcaggttttatagttggagaaactgaagcacaaataacttatgtgggtaggaagttgaagtttgggagttcaaactcaggctcaaatgattctagacaaataacagagattcatgaaggttacatgagagagggccagataacctgttgaaggaattgacagaatggacttggggtggctcctgggtcaagtcaagaaggacaagctgcttttttatatgtggatatgggtgtagagggataactagtcctagaagcagattgttttccctttaaatcaggacagagctgctctgtgaacccagtaggctggtgcctttaaagagtgtctgggagagatctatgtaaatacatttcctgttcaggtgctagcacactgcattgttcatttattatttatactgcgctctacccaaaacatagtgggtacttattaaatggttgcaattaccttacctatgttggcatgagattaaatttattgtattgtctagcatttccccaaagtttgctctggatatagcaagatgttccttaaaaaaataaagtgaatcatagttaaataaaatgccatttactcaagccccttccaggaaatttcctggtatagataagcattataaaggctctgagaaattctacagtaaagaaacctgcttattttcaatgtggtgtttcccaaacctacttagccacagaatccttttctatataatagaaactttggggaatattgaagttacccaactaaactttgacagccctgcaagggaggaattattattcccactttccagggaagctcatctagtaggtcatggagccacggttagacacccacatctctgcctctggaacaaggactgggcctaagttcatacactttttttttaaactataaacttaaggaaacaaactactatcatttttcatgaatggtttaagtgcacacctgtctaaagctgagaaacagaccagaagctgacctctgatggcatttggtattggttccagagatgggactgaggagatcctgttatttcagagctcagtaattcaaacaatctcaatccattcatcttggcaactagctggcacacccctcactggactaatgaaaaaaatctggccatttgacagcaaaatcattcttattaaaacaattgttccagaattcattcttccacagaactcattcttccagaacaattcttccagaacaattccagcagaactcattcttccacagaaaacagtggaggtgaacgtgctttaggactggaaggcagcaatgctctttccccaatggctccctccagtatttccctggcatggctgggtgtcagacggaagcatctctgtcccccacacctgccaaatgcctctctgcacagtagcccagctgttctgccagtgagtagcatcaggaactgagacgggtccttctggcccatggcaccacctgtgccttgggggagaaccttgggtgagggtgagacgctgagcctggtccttgcccagcagccccagcctccagtccctctgccaggaacttgggtcatgtctctcacaatacgtaggttggccaggcagtccctgtcaagaggaagcaggatgaacatttggggacaactaagggatggagataggcaccttatcctagaaagtagcatcaagtcaaagctgtttaattatcgttgcatggccctgctacagggcaggaagcaggaaggcaaggggatgaggaggggggcaaaaggagggtctttagaagtcatttgcctgaacatgttttcttgcggaatttcctctgtagggtttaacatactcctctgaattcttatattcacgtaacttttttttatagcaaagtaggacacacaaaacaacagtgattcttttttgccaaggcatatcaacctgatcaacaatttattgagcacttccaagtgtcaggccctgtacgaggtaaccatgagacagagtgacaaataagataaacggaggaggtaggtcaggactgactggtggttttgaaactgtattctggaggttttacaaaggtgcctaaggggccttggtgaggtgtcagggtggtgaggggttgagagggtggggtcctctcctgcatacctgccctctctctcactctgtctctccccaccaacttaaacagctctgttctctgtgttttcttgcagggagagctgttgggagacttaatttattaatgtctataaagccttcaggaatttttgaaggtactttctgcagggcaggtccaggaacgggactcttattaatcatgcaaagagagatgccaatattgattgccctaatggattctggcagagaaaacacacttgaagttaattgtttactgagagctttcaagcagtgcaagcactggccagacctggcacttgctcaagcacctacttgctccttttgacagtttgctgtggcagctgctaggacaagccctggagcaccttgaggtttggatgcttctcatgcaaactcaatgaagggtgcctccaggccttgtgaagagagggaatgaagaagattcgctgacactttgccctcagacatgtctagggagatctgcaacctgctgagcactggacacctgggttgctgtgcagacatgtgcaagaagcacatggacaagccatcctgctgctgcttttccttgggcttatgatagtcataggcaggaggcagctcatagaagacactgggtgcccaagaatgagtccaagtttcgagtctgcctcccttgctgcctcatttgtgactttgggcagccgacttctctttttaagcctgtattttctcatgtgtaaatcaggggacagtgactgttcctatatcatgggattgaggggtttaattattcatggaaaatgataagcacatggtaagtgtccatttcagtattatcattattattgacacatgggagaggaacgattcaacaaagccaaaggaaatgttcagtaacagcaacaacccatttgacagtcttggtctgggagtaatgcttgtcaaaatgaaaactaaagcagattaaaggacctgctttgttgatgcaaattttcgatcttctcaggaacagcacgaataatttttttcttcacatgctagaatgcataaatctaaaacttctctccttagagagattcaccagatggaagcgcttttcaaaggaatttcaaaatctatatatgtagcacaaacagggtcatgtggaacactgtaccagttgtcatcacattcttgatggcccttaaggctcagtctgcctgagttccactgatattttatgagctacaggaattgcattcagagcacatcttgaaggaaaatgtcatgaacttatctttccaggggccaaggcagcaatcaaagtatcagctcacaactcttgtgttatatccctcattcaagcacattcctctctgcaatctacttgctcctggaggagtttctggaagaagtgtgagctctcatccctcctaaggcatgtgaacgcagcacacctgtaatttcacagctgcctgcagttgccacagtaatgcaaatgtttgtgttggcttctccgtgaactctggaaatagcagcaaaatgtggcagagttgcttctgcgtaccaaaataaaagttacaagcttgtgaaaatgaatcactgtgacttaatgaaatctgtggcctaaatgtgtgcttgctgagaaaactgaagttggatgcctcctttaaacagaatgaaaggggagacatgaatgaataaatgaataatcattcatttaaaatatttatcatgggtaggaatcatgatttctaaaattctgtggggattttctactgaagggacttggtaaatttacaagtgtaattaaggattaaaggtgatgagtcttaacaggcagaccattttatacacacctgccccatattctctcatcagatgcctatccctcttttggaaatagtaaagagcctggatctgaacccagctttgctgtttccctgtgtaagcttgggtaggtcactgcacttcagtttcctcatctgtaaaatgagaatcataataatagtgccaaagtcactgtgctgctataaggaattcaataagctaatatgttaaaaatatttagactatgtatggcaaattcctatataaatgttagctgctgcaactactattattatcattatcataattaccatcagattctcctggtacattcttcctcctccaggataccctaaagttccctgcatcaccaacactgatgggaatattttaaggccagagatatcctctttagaaaatggttagagttatagcatctccttgaccactgacctggattaacgtttcggatggattgaaagtcaccttgaaagacagaaagtacaggctctgagaggctaggatggaaaacaaggacagtacattaaatggagaagagagtttgtctcgcagcaaggggtaccacaaggggttaacatgtcagagtcctcttacagccatgtttctcaactagaaatgattttgccccccacaggcaacatttggcaatggctgaaggcatttttgcttgtcataattgggagtcagctaccactggcacctggcaagcagaagccagggatactgctaaacatttaacaatgcacaggacagcctcccatagcaaagaattatccagctcaaacatcaatagtaccaaagtttaaaaacccagtgttaggataaaccttggaaaaaccttgtttccaaaggagcttccactttaggttgcacataccgttaacttccaggtacccaagagctaatctagtttccaaaggtgactgatttgcgtctaaaatgatttatgtaggaggctactctggtgatgcagcaatgatttattactaagcactctcagctcccagagacagaggctgaggagctggcttggtccccaagcacccatacagctttcatattagcactgaccagggggttattacctttatttttagttcactcattgaaatgtctatatatactaggctcagagtatctttttttttctcttttatttcaataggctttgggggaacaggtggtgtttggttacatgaataaattcttcagcagtgatttctgagattttggtgcacctatcactcaagcagtgtacactgtacccaaggtgtggtcttttatacctcgccacccccaaccattcccccaagtccccaaagtccaatgtatcattcttattaggctctgagtcttcggagatgattcttcaaatttaacctgtctaacacatgttgaatatattcttttcctttcccttctaagcatgttcctgccttcaatctcccccatctcagtacgtgccttggccatctccctttctcaagccagaaacccagtcaacatcctccgtgtcttcttccctacccattccataatccacaggcagatcctatcgatgccactcctaaattcatcttgaaagtttcctcttccctctactgccactgccctcgcctgaccactgtaaacaactttctgaatagcctccccatttttagtcttgacaatttctaatgaattctccacacaatggtctgagtaatcattttaaaaataataattaaagctatcactcttgacctcctttgatggtatcccactaatgcttccaataaaatccaagccctttgccgtggactgaaaaaggcttatatcaggagtactcatagagtggtccccagacctgcagcatcacttggaacttgttagaaatgcaaattttcaggctccaccccaaacttactggatcagaaactctgggagtggggcagcaatctgtgttttcacaagctctctggggagttgggatacatgcttgaggctgagaaccactgctttatgtgctctgcctcctgcctatctccctgcgaccccaccgtttcattccactcctctttctgattacgctgcagccaaatgggcttctttccaattacttgaacatgccgagagcttctctacttcaggtcctggcatgcgctgttctcactgctcggacacttttcccatctctcttgagatgcctcctctgaccaccttttctaatgtagctttctgacccaccctcgattctttgtggctataatcatggttttcttcacagcactccccatcactagttgtattctgtctttattttctagcttccttatgattatccggttctttcactagtccattagctccctgaggccagggctctgtctgttttattcattaatgtatatgctatggaaaccacagtgcttggtacatagtagtaaataaattaaaggcctgaatgaattagcacttttaagtcacttttagtctagtgcagaaagagaaaatatgtggcatacagctcccatttccagcctggaccgagaccgaggagacatcaccacttgatctccagtctttccctcttaatcctggatatggcctctgaatttttcacaaccctccactctaagcatctgctaaaaaaataattaaaaataaaaataaaataaaagttgttacttggaatgaaagtagaagtacaccaatttcctaaatcaccaatttcctaaatcatatttcaatagttgcatatatatatataaaatatatatgtgtgtatatatatatttgagacggagtctcgctatgttacccaggctggagtgcagtggtgtgatcttggctcacagcaacctccgcctacctccgcctcccaagttcaagcgtttctcttgcctcagcctcctgagtagctgagatcacaggtgtatgccaccacgcctggctaattatatatatttttgagactgagtctcactctgtggcccaggctggagtgcagtgggcgatctccgctcactgcctcctctggggttacaggcacccgccacaactgtggctaatttttgtatttttagtagagacggggttttgccatgttgaccaggttggtcatgaactccaggcctcaagtgatcctccccactcagcctcccaaagtgctgggattataggcgtgagccaccgtgcccggccaagttgctaatattatttatgtaccagacactgctaacatttcataagctttagttcccacagggtaactggcagacaggtaatctgaagccaggctgtctgatcacagagcctgcaatcagggcgaaatcctttcaccatagtgagaatatatgtattggagttcagcagtgagagactaagggcggagaacttaacccagttgaaggaatcagagggtgcaatggactgaatgtttgagtccccccaaaatttgtatgttgaaatcctaacccccaaggtgatattaggaggtagagcctttgagtggtgatcaggtcatgagagcagagccctcacgaatgggattattacccttataaaagccttaagctccagaaagcttcctccccgcttccaccacctgaggacacactgagaaactggcagtctacaccagaacctgaccatgctggcatcctgatcttggcttttccagcctccagagctgtgagaaactgtgtttacaagttactcagtctacagcattttcttatagcagcctgaacagaataaatcagaaaaaatcctggaggagttctgaagtttgagttagtcaggcagagaagtagagaagcaaaggcatgaaccctttactcacacctactcttttctgaaacgaggtcttgggaagaagagagctttggttaaatgtaccacgttcacaggatggtgtttggctgagcacatcctattcagaggcgactgcctacctctcacctcagcagattcttcagtaataatcttctttttaaaatattggcagtatatctgatcttggtgaagtttatttatataaatgaatggttgggtgtggtgggtaaagcttaaaaggtccctaggggaagggggcagagctttttaagttatttttgtgtcctggataaactgattcacctctcttgggtcaataatcccgtcatgtaatgagttatgttattgttggaagtgtgctattcatgtgcaaaatgtgatgctgaaaacgtttggaaaccatagacatcaattattaaactattttaatgaaagtaagtgtttacactaaatagcatctctgagtgtgatccaaaaaattacaaatcattctcaattgacttgcaatcaagagaaatctgcgtggagctggaatttatagcacagcctacacttccatagcaaccaactgatgtcacatacggaactcagacttccctgacgggcccaggattcagcttggaggtatcatatgttcagttaagcataaaagtgacttcaaatttagagaatgcttttcttcgaagagattaattttacttaatttgattttgagaggaagtgcttaaagcaaataagatgattctgctccagtattttaaccaaaaatagatgtagaaatctcatataattcacaaaattgagcttgacatgatgccatgcctctataagtctctatggcaaaaatacagaattctcaatgcagaggagagataatttcatatcagattcaatgcctttctataagagttcctggaagtactatccccatataagcagcatcagaatcccctcagaggcttgcaaaaaatccaaatttgggtctcacccagaactactgaatcaatctttgagggcagggctccagaatctaatattttaatacattttctagaggattcttatttagaaccattttttggtggaattcaaataaagaaacaagttttctttatcatatgtgggaacaggtaattcttgaacatcattgaagcttaatgagaaataactgcatagcaggcccctaggttgtaagagtattctataatgcaaagagaacgtttaaaacatctgcaaatatttggaggaaagcaaaatggtataccgtagtaggactagacttctgggtttcaaaatccaggaaattttaaaaattgggcaaggggatcaacataaagtcgcctacgtttatgttgccaaaagggcacttaaaaaagtctcactaactctcactcatttcataaaagggcatttttgcaccacaaaagaaaaaaaacaagaaagctataatcccagaataaaagacaatcctttacatgaacaactgtaggaataaagacgagccatttgatgtcctgtcctattcattttcatgaatggagctctgatacttgggaagctctcaggcagtggagagaccagtgttttggaaagataaaaaagtcaattctaagctcttcctcttgctagctgtgtgatttgggcatcacttacataaccaattggtcttggtttccttatctataaaataaagataatcatcgtcatgactattaatgaccttacatggattaatcaactgacatacagaagggactcaaaaaatgtccacattccctggttttgtcttctatggatttacaatctactaagacccttgttggacttgagacagacttgagacaaagtgttgcttgagataaaaaggaggaaaagtggctgattaactgattgtccctagcattttatttttagctttttttctcttgctttagattctgacggagtttcacattagacagattcttaatacctggctattactgactatctgaaatagcagttctacaccttgtttgtcacaaaatgcacagggtacaagtaaatccttgctataggtgtttaaaaggctgtctaggtcagttctgctttttctgttacgcctatttatgaagaagttatttccccaaagtaaatataggccaggtgattatttgtagagggcacaaaaataacttaaaaagcttgtttgtatagggtgcagagaagtgcatgattatttatatagggtgcagagaagtgtgtgtgtgtgtgtgtgtgtgtgtaacagagagaggtagagagaggaggaagtggaggatgaggaggtagttgctctgttgtggaactcgaaggacaccatcgatactgtattctatgtgaatgatgtcccattgctaattgtgttcccaaggagttgtgcaaaatggtagacctgggtggaggaaggcatatagataaatattattctacaaacagagttcacacatggctctgcaaggaatttaagaaaataacttcatagctaacattctttgagtgcttacatgtcaagcactgtgctaagcagtgtacagacttggccacattttattcctcacaacaaaccttcgattattatccccactttccagatgaagaaaccaagtcttaagcgaacacttgcttaagatcacccagctgatcaatggcagatgcaggatttgaatccagatctgtggaaatccagaatccaaactccatgtcattttgctaaaccactcctccaagtaaaaaaataaaaataaagataagatagaaaagagagatcttattgaacactcatgagtgttcagggagggttgttttcacttcttttcctcctcttaaaaggtagatgaccagctttggctcatattctaactctgtgaaggtaggaggcaaaagttttgtggaataactcattaatcaatccctacagcaatcacatctctgttttactggtgcagggggctctcagtgtttgtggttctttcatcataagttggtcactgtatttcctaaaggaatgacctcccttcttcaagaggtaatcacacatgccctgctgaactggacagaaagcggtagccaaatatcctgtcgtcaagcctccttcaagataactctggtgagtggttattttggaagtggctctaatctgtcatgttacacggctttgctaagactcactttattagctaccaccaagagctaataaaacatgtcaggaagtctctgtaagctgtaaaaacattttcaaaggtcactgccaacactctggacttcaatgactatttgaaggaaaagaaaacaaaagcagaggcctagagttccaaaacacagaactaccaaaagaagcaatcccaaatgagctataaagactgacaaacccacatgataccagccattggataaactgtgtccagaaggaggcttgaagaaaaggtacaaaagccacaaaatgccagtgagtaggcagcaaatttagatttagtgtataggaacctgacggtcacacctacttatgcttccagcacctacaatagagtcctttataaacaaaggagtaggtggcagagaagtaattaactttagattaaccacagcatagcaggcattcttcttaactgacttttttttttctattgtaaaagtaaacatactttttaataaaaattagtaaaacatagaaaaggagaaaatcatgttatcttaaaagctgggaatatagtttgatgcccactgtatatttcatgtattgagagtcatgctttgacagtgagatgtctcaagacaagtggctgtgagccagcagctctattagattgaaaatattgtattaatcattgagatttccattcactgctgatgagaggtccaggcacagaagagacaataacattcttatcttggcttaggataaaaaatttagacatgaaatctgtactttgtttggggggtggagaaaaggtcatctgtggagtcattaagtcgggatgtcttgttgtagaagcatcaaaagaccgctgaagcggggagatattgatcaaagggtacaaagtttcagttaggaggaaaaagttctgaagatgtgttatatactgtgttgcatatagttaatgcatatactgtattatgtacttgaaaagtgttaagagactagattgtaaatgttctcaccacaaaaaatgatatgagttgattcgtgttcattagcttgttttaatcattccacgatgtaaacatatatcaaagcaacatgttatacaccataaatacatataatttttatttgccaattaaataataaatagattttttaaaaaaaaaaagactgttgataggttggtatgccccagacagagagaggcaggttctatcctgctttggaacagttgctagcctgctcactgattgtgcatggctgtttttaataacttattgcaggcatcaacagggagcgaatgtgattcaatccttaaatactgcaacgctcagtgatctagtcaataacaggagataccatatgggtgtgttgtcccttcctttgtgtttctgttttctttttcctcctctacttgctaagaaaggcaacacagaacggtagcaagagcccaggtcctggagccaagctgaccagggctgagtcaggctcagcctgatttgctttctaactttaggctcattctgttgctcctcagtggcatctacacaatggagataacaataggactcgttcaaggagcacttgcaggattaaatgagacatgcttttaaagcactcagcaagcagcttggcatgtacagaacaatcaaaaagtgaggaaatcacaattattgtgttactggctgggagctttgaggacgggggttatgttaccttttttggatactgagcacaaggtgcctggccacttaaggtaggggtgtgggggagggctctaaaaatgctcaagaataaatgaatttggttaaatttatttcaggttcctttcctgatacactttccctacatgtatttttttccttctccaaaatagtaaaccacattttcttttgcttcaaacagatgtatcactgacagtaggttgaggcaattctcttattttcttgttcaagaaatatttatatttcttgtattattttttatattcagcagtccttttcccccttctctattcatagctttcgtccctgggggaactgctccctcagtcactggggctctggcaagtttgccaatcggttatccccaagcccactcctatccaccccaattcacacacaccagaatcattatttgactctgaggtcaccttctttctaataaatcctgtttcctactcaggttagtcagagtcagtttctgttgcttgcaaccaaggagccctaaatgatatgtaccttgttttttcttcctttctaatcatatttccttactactttatgtttcccatatttctccttgactatctaccactatttcaccttgactatctaaatttagtctccttccccactgaatatggcagaatttattccagtctgtgaataaggatgacatcatgtctcttctaataagttcagccctcttcttaactatcacagtgtctccataaaattcatttaccctcaaggcagcctgatttttggctgagcaaaatgttaattttagcatcctaggtgccctaagacttagctattacaatctcaaaatggtaacgcatttaaccatccacgttaaccctcttcattttacagtaaggaaaaaggaggacagacatttaatgacttgtgcaaggccaaacaccaaatcaaggacaaactagaatacaatctcctgatatttggtaagatgccttcatcatctttttgagcagcttttaaggaaataatattttgggcccattccaagcaaattttctttgtgtagtggaaaagacctttgtcataggacagtaacatctacaagacagtccttcttctttgttcaacagaagttggggaagagggaaaatgcaggaagaaggatagcgctgttcaagagaaatgcctcatactatttcttctatacggaggtgcagagattctccataactcaatcgttccaagtcatgtggcaggcctaagatgagacactacgattatgagttttacagaagtggcaaagagaaaaaaaaaaaaagatcatcaagattgctatattaacagccccttttaatataaggcttttcatctattgaaccacagcatagagttaatacatagaaaacaactctcaaataaatgcaaatcaataggctctccactgattattatataaagcaacacattacaggggaataaaccaataatgcctctatattttgaagtgttcactaattctgagtaattacctcctccaatggctctaatgagtgcaaatctgtgaaatttgactacatctttttccttatttaaatactatttttttagttcatagaaccctcacaagattctagtaataacagaagttccctcccaagaattgctttcatgactaaatattttataattcataatatactaatcttctatgtacaaataaatccttccaaagtacttgatagtttgtggaattaacttgctcttttagatcggctaaaccaatttctctgcaagtactctttagatcagggtttcttaatctcacacaatccacatttggggccaaataattgtttgttgtgagagattgtcccatacattgcagggtgtttagtagtatctacccgttagatgccaggggccaaaaagtgtctctagacatggccagatgtctccaaatctctcccagttaagaacctgtgttaggccactgataaattttttacccaagtctcccgtcttttgatagaggatccaaagataaatttatggcatgccttcttcaggaatcccagatcagcattctgggttacctcagtagaaattaaagcaaatttacctttaatcacacagcatcccggggaggagctcatgtgttgttatcttcatttcattgtggagaaacagaatccaatgtcacacagtgggacagagatgtctcctgaaatgtacccctcctcccaatctgggcagaaggatcgtcatctcacttactgccttcttcccttcaggatataacatttgctctggaggattttgtagctcagagcaagaactaaccaatggcaactatctccttgataatttagggcaagttatctaatctagagtcttcatggttttctttttttagttataaaaatgaagataataattcctacctgtaaggttgttactcagaattgaagatcacagtagacataaagcatttgacacagagtctaatacagagcaggtgtgcacaataaacattaggtctttcattccctcttcatggagaatctcaaaccaggatcactacatgagctaatttggaagtcatgattgagacttaaagagctgagtagaaaagcaagcagtgcatgtaccacctaccagagactgggtgagtgtggaacccatgtcagggatgcagaaaccactgtgacgcagaaatactgaccatgtaataccaccaagtatttctataaatagttacatataatcaaatactgtgataccttttaaaagtcacgtataatctgaatttactaagagagataccagggactgttgtggcaaattactcaaaaggtatatacaatttgtcaccttcacctaggcatccccatctctagttgctagtaggctgaaactatatgcaattgctgatgggtggctactttttttttaatctgcaaaatggcaattttttagcagtcaacctgagttctgggggcaggggggtgggaaacagactctttcaaatatttaaaatattgagtccccaagtggaggtcaaataaattattcttagttaagtgaggaaaactctgaggaaaccaagcccacatgagatctactattatcatgcatgaatgacattccattcttccctatctctctctttcataaactcaagatgcaaatttatagagctctcaaaataccctccagcaaaagaggcaggtgccttatcccacttcccagtggggccctgaattaatcacaggaggaaggctatgcctcatctgaaactgcaaataggctattaaataaaagagatggcatacctgtgccacactgggcagtacaagagaggagacgacgaagcacacaagggcaggtggaaatgcaaaagccaaatttcagaccattatggctttggggccagtgagcatcctgtactcagctcattcccacctggttgccctgttagggaacagaaagcactggggagaaggttagagctccaggaacttggctgagaggcaagttgctgaacaactgttttagagtatttcagacacccaggtggaccttcactgatggggtctggagacccttccattaatacaaatcttgaaaactgtcttgtgcacgtctctgaacccatccgctaatctgaaggacagagtgatataaactcccaaatttgtatattcaatcttaacctcttttccaagcctcagactcctttccctgactgccaagagatcttctctatcttgaaaatgtattagcatctcaaatttaatatgtccccaaatgagatcgtatcttcctacacgtgcctaatcctgtgccacatagctcagtgagtgctatcactactgactccattcctggaggaagaccttcaaacccggctcgaagttctttttcattctctccacatatctaaatatgaatccctcagaagtgtaatctcaagcccaactgctcctttcgatcccacagcccctgccttaaatcaggtacttacttctcccctggaaattacagctgcctcctgcctgtcctctctgctcttcactgccccttacatcagtctctcctgcaaactgctctcagaatcctcattcccaaaaagtgtttttaaagcctttatattgtttggacattgtccacaacacagttccttgacaaatgagaatgatagatataaataacttactttgtctgtgacagagaataataatacttacagtaattattgattgtattgttaattgtagatacagctctccaaaacctggcctcaacctacccttattcctgccattcacccaatgcacccacttttccccattgcggtgacctcctctcagttccatgagctcaacaggctgttttatgcccgcctagctgtgcacatcctgttccctttgcctggagggcctgcctccctccttccttcccaaactgccaggcacacagttacctttcaagactcagctcaaaaatcacctaggtaaagccttccctaatgtcctcaggtgaaattgaaatgaatcattcccttctcagaggaacatttgtatatttctactctagtagttcctacattatgtggtgatttatttgtctagactgtgaacacttcaagaacaggtgtgacatcactcacttttatctacctatatctagcacaaagtcctacttagagaaggtccattaacgtacatgaaagggatggccactggccttttatgatggttcttctagtgttacattaaatgtttaagacaatcactcaaagggggcagtttttcttagatgctttctagtccttcttttagcatttcttcaaggagagaatattaaatatctagcttaggcttctgtggagaaggcaaaagtatctgagacccataagtaggacatcacaaggttcctcatttccatttagttgtgatacaaattattttatctgcttgagaacttgtgttttgatctgtccatgacaaggaccagaaaccagttcaagctacggaaggcaacaggggctttacagtgatagaatatggcacccaagagcagaaggtgaagcccagcaatggaaccgggccagggaactgaagagcaggggccgggtgctcctttccagcatgggccacgcggtctgccttctctgcctcactctactccctggagccattcccttctgtttcacattctgtgagacttcactccctcctcatttgacacatagatgagccccagctggcaccctcagcctggaccctgtgacttttcgattcaatggctcacgactaacaacttccctctggatcttagtgcaaaagtcctgaaagaggggctgtaggtggcccagggctccttttgggtgacatacaagtcacgtgactgtctcaagtcagtgtccaccctggtccacggaggtgggacctgtgtcaacgacaggtgggatcacacagacaaaggcaccctcatctgggtctgtgagcaaagatagatgatctgaaacaggtcaaaggcagtactgacaactccacaggtatattaccccttaaaaaacttgccctacaagtacatttctgcctcacccttcatccctggtggctgtggcagtcttctgatctgctaacatccaaggtacctaatggagcacatctagaaatcaaaagttaaatcttcttaataaagtaatgaggaaataaaatcattaaagaacttcaaagcaaggaaagcaaaagaaaaacatacaggtaagcaaaggttagaaacttatggcaaacatactgatctgtctcctatctgaaatcagattttgaaacatgagtaaccacaacaattttgggagctaaacttcatttcatccattactccacatactaggtgggtattatgctctactagtttttttctggtctcttccaacagcctagcgcataatgtgcagatatttctgtcctgtagagaatacagcacagaaccttagagtcaaataaactgagttctgccatttagcacttgtgaccaagggaaatacacctaacttctctgtgtcagtttcttcatctataaaatggaaataataaagtcaactttgcagagttcttgggaatgttaactgtaacacttataaagcacatattcctgtgtctggcatatgaggaatagtcaataaacggtaaacatttggttgaaccacatgaagttaaaaattaggcaggtcataatgttatatgctcccccgatcagaggacctttattatagttgtgtatttatatgtttctatcattaaaatgcaagctccatgagagcctggactcggtctatcttgattcccacacaatgcccggcacagcacttcacagatagaaggtgttctatctgtattttttgaatgaattaatgtggataatgatgatgacaaagatacctcttctgtactgcctacatctggggacaattatagacaatacagtcctttatctcattgcctggtgtacaataggaacacgataaatgtctattaaaggaaagaatgagtgagcaagtaaatgaatgaataaatttcaagtccatatacagaaagtctaatgagaccactaagttaacaaaaattgctatgaaacttgtttttggtaattgctatcacaaaacaccaaatggggactgccttcattttcatgtttccagcaggccctttggtgttgtgtggacactatcagggttcacttggccccgtgggcctcccaggaaagtgagagaggcaaagtgctgaactgcagcctgccaagccaggaaaatttagggttgtaatgtgtagcttccagaagtctgctggcttttgtctgctcagagacagccaacagcttgcaattgtgcgatgagcctttagctgttggagaccctcccatggtactgtatatggctcatgctccttaacacaatttttgtcctaagagcctgctaagttgactccctgcatctctcaccaaacattcaaccttcccaacagggaagcaggttaaaagggagactagtcatggaccgaaaaaaaaaagtttggtatctggctctgatgaccactggctctgatgaccactaggaaagcaggaaagatcctgggctggattgatcaagaagacagaaaaaagaactaaagtgaagaaaggaagacttaacctagccatacatatgtctttaacatttcaagtaatggccagtttatatctctggattttagattgaagtcacatttaggggaggagaatgttctctctgcttttgacaacaaataaggagaaacaaagtatgaaaggtagaacatagttacacttaggagaaagtcagttactttaaattatttaagcttcaggaaccacaaatatgcacatatagggagaagggaaaaggaaaaagttgttaagatcccaaagagaaacacactaaagttatctctatctcctaaactgcttaatgcttggtctggctctttactaattttttttttttttttttttttttttttttttaagagacagggtcttaccctgctgcccaggctagagcgcaatggtgcaatctcagctcactgcaacctccacctcccaggttgaagcgaacccagttaatttttgtatgtttagaagagacagggtttcaccatgctggccaggctggtcctgaactcctgaccttgtgatccacccgcctcggcctcccaaagtgctgggattacaggtgtgagccattatgcctggcctctttattaaatttttaattgttatggatacataatagttgtacacatttatggggcacatgtgatattctgatacaagcatacaatgtgtaatgatcacataagagtaataggggtatccatcaactcaagaatatatcatttctgttgtgttaagaatattcaaattccactcttttagttattttgaaatacatgctaaattattgttaactatagtcgctctattgtgctaacactagaactcactcctcatatctaactgtatttttgtacccattaaccctcctcgctttatctccccctccctattatactttcctccatctgggtaaccatcattctattctctatctccatgactaccctttttttttctttttggttcccacatattaacgagaacatgtgctatttatctttctgtgcttggcttatttcacttaacataatttcctccatctatgctgttgtaaatgacaggatttcattcttttatatggctgaataatattccattgtgcatataaaccacattttctttctttctttctttccttctttctttctttttttttttttttttttttttttttgagacagagtctcgttctgtcaccaggctggagtgcaatggtgcgatctcagctcactacaacctcttgaactgcaaagttcaagcgattctcctgccttggcttcccgagtagctggcattacaggcatgcaccaccacgcctggctaatttttgcgcttttagtagagatggggttttgccatgttggccaggttggtcttgaactcctgacctcaggtgatccacccgccttggcctcccaaagtgctggatttacaggcgtgatccactatgcctggctaattaaaccacattttctttataactcatcttaggttgactccatatcttggctattgtgaacagtggttcaataaagatgggggtgcaaatactgatttcccttcttttggatatatactcagcaatgggattgctgaatcatgtggtagttttatttttagttctttgaggaacttctgtactgttctccatagtggctatattaatttacattcccaccaacagtgtatggggttcccttttctccacatcctcaccagccttaattattgcctttcttttggataaaagccattttaattggggtgacaggatatctcattgcagttttagtttgcatttctctgcttattaatgatgttgaacatattttcatgtacctgttagccatttgtatgtcttcttttgagaaatatctattcagaacctttgtcttttttttttttttttttttttttttttttttgagacagagtcttgctctgtcgcccaggctggagtgcagtggtgcgatctcggctcactgcaacctctgcctccggagttcaagcaattctcctgcctcagcctcctgagtagctgggattacaggcatatgccaccatgcccggttagtttttgtatttttagtagagacagggcttcaccatattggctagtctggtcttgaaatcctgacctcatgatcagcctgccttggcctcccaaagtgctgagattacaggtgtgagccaccacgcccaacctgtccattttttaaatgggattatttaggtttttaaaattgagttgtttgagctccttatatattttggttattaatcccttctcagataggtagtgtgcaaatactttcttccattctgtgggctgtctcttcattttcttggttccttcctttgttgtgcagaagctttttagcttgatctgataccatttttccatttttgctttagttgcctgtatttttgaggtcttaccctaataccaaaaccagacaaagacacaacaaaaaaagaaaactataggccaacatctttgatgaacacagatgcaaaaatcctcaacaaaatactagcaaactgagttcaacaaggcaaggataattcaacatatgcaaatcaatacatgtgatacatcataccaatagaatgaaggacaaaaaccaaatgatcatttcaactgatgccagaaaagcgttcaatgaaattcaacattgattcatgataaaaactctcaaaacctgagtatagaaggaacatacctcaacatgataaaagccatatataacatacccatagctagaatcatatcgaactaggaaaaactaaagtttttatctaagatttggaacaagacaagaatgcctactttcatcacttttactcaacagagtactggaagtcctagccagaacaattagacaagggaaagaaataaagggcatctaaatcagaaaacaatgaagtcaaactagccttgtgtgcagatgctatgatcttatatttagaaaacctaatgactccaccaaaaaactattagaattgatgaagaaattcagtaaagttgcagaatacaaaatcaacatagaaaaatcagtatcatttttgtatgccaacagtgaacaacctgaaaaagaaaccaagaaagtaatcccatttacaatagctacaatgcaatccctgtcataacaccagtaatgttcttcatagaaaaagaaaaaaataatccttaaatgtatacagaaccacaaaacctggaatagccgaagcaatcctgggcaaaaagaacaaagccagaggcatcacattacactgacttcaaattatgctacaaagctacagtaattaaaacagcatgatattggcataaaaacagacacatagaccaatgcaacagaatagataatccaaaagtaaatttatgcatttacagtcatcccattttcaacaaaggtgccaagaacatacattgggaaggacagtcttcttagtaaatagtgctgggaagactagatatccatatgcaaaagaatgaaactagatctctctctcttttcatcacatacaaaaatcaaatcaaaatggattaaagacttaatcgaagacctgaagctataaaactacttgaagaaaacactggggaaatgctcaaggacattggtctggccaagatttctttttttcttttttttttttagatggattttgctcttgttgtgctggctggagtgcaatggcatgatctcggctcactgcaacctccaccttttggattcaagcaattctcctgcctcagcctcctgagtagctggaattacaggcagctgccaccatgcctggctaatttttgtattattattagcgacggggtttcaccatgttggccaggttggtcttgaactcctgacctcgtgattcacctgcctcagcctcccaaagtgctgggattacaggcatgaactaccacgcccggcccaaagatttcttgagtaagatttcagccccactctgtgtaacctaagaggtctaggaaagactgaagcatcctgcatttaccatctgagtttagaaaaaatgtttagagcacaacatcagggaaccattcccagacgtggctgtggatgctgccatttcttgtgattctggagctgttcttttcatctcaagctactgtttacagaagtgttaccacagaattataattatgggttttatttagttataaagagggtttgagtcttccatcaaagggagaggaagcaactcactcagaagtgtggagaaaatctttcacactcactgcttgatggaattccagtagtctgcatggattcaggccagagcatgaacccctggggcatggagagcttgattttatggtgggcaggagggcccagagtactggccttccttcctctcttcttggagaagcagtggtgataaggtaggaaaggaagtcctgggcttccaccaggccagcttccccacccatgcagacttccttctgctccaaggaaactggtcattcttatctcttctgcagaaaatgaaaccagaaactcccaggcttatgaaggagaggctatctgggcactgggaaggtggagagaggcttcccagtgttgtctctggcaagacagtagaatccttgggaggtctatttgctcctaatattgcttcctctcgatttctttccttcagttttttcccccatttttggctctgatcctaaaacttgggctctgcattctttgataatccatcacacctcagatactggggacctgagacctggtcctacctgccctagctggtatctccactgaatcctcacaggcctttctatctccagagactgtttctggccactgagcccgatgcttgggacatcaatggctcactgatgccccagggcctcctcctaatctctggccgaggctgacacagaaggctcacaacaaaccatgtgcctccgaaataatgtgatgagcagagtaaaatctgttgactttttaccccatgaaagctgcatggtttaaatacaatagaggtgactcagctactggaaggatgcatgtaccacgtctgaaacactcagcaagctctgtggagttgatgaagcagggaaattgggagtgaaagtaaaaatttccgcttcctcagaaaaatctgcttgacactatctagcatccattcattagacttaatcttcagcctgtctgagttcccatgaatctatatttctgcactgagatggggcacgtattttctaccaacatgtgagcaaagggggaaatccataactttgacttccttcagttggcttcctcttggacctgggacattagcattccactaacatttggttacatgaagctacattttcccagtgcattattttgcatcttgaaagaatgcagtagctgtagctacaggacctaccatcaatcactgggcattaatcctcactgagtggccctcatgctgtaacctcactgtgcctattctgcttaaggtcctggtggttgggctgatggagaacataactcctggttctcctctcccgcctctggccccccagcgttattgccagggaatacacttgctctggggagctctgagcttaatggattttgcagtatttccccttccttcctgctacaaagctctggcttagcatgaaagctgccccagatccctgaacccatggcacccttcctgccttgaggaactcacccctctcctgcagatcaaggctcagtattagcctatataaaaagcctcctgcttagtcataacaggtataccaactaccatttacagagtgctcactatgtgccaaccagtgtacaagtaccctgtgggtggtattgcatataatcctcacacaaccttggcagctggcactgtctttattcccgtatcatagttaagaaaactggaacttaagttaggtcacatagctagaaagtgatggactggaatccgtccattcaacagatattattcatgtcttactacgtgccagttattgttctatggatcagggatatgttggtgcacaaaacagcctaaagctccttcccttgtggagctgacttccttctggtgtttaaacccaaagctgcttggccccagagctagacactatttaattcagagacgatcacagccacacagaaagattttctttaaaatgtttgatcataaccatgatgagataccatttcataccattagaatggttactatcaagaagataaaaaaataacaagtattggcaaagatgtgggaagtcacaaccctcatatactgctggtagaaatgtataatggtgcagccactgtggaaaacagtatggcagttcctcaaaaagttaaacatagaattatcatatgctccggcaattccacatctaggtatatacccaaaggaattgaaaagcaaggactcaaatagacacttgtacctcaatggtcatctagtagcattacttacaatagccaaaaggcagaaacaacccaaatgtccatcaatagataaatggataaacaaaatgtggtatatatataaaatgaaatattaattagccttaaaaaggaaattatatacttatgacagcatggtcgaaacattatgctaggtgatataagccagacagagaaggacaaatattgtatgatttatctttatgtgagttgcctagaacagaaaaattcagagagacagaaagtggaatagaggttatcaggggctgagagggaggggtggggatgaagagtcattatttaatgtatgcagagtttcagtttgcagtgatgaaaaagttctggaaatggataatattgatgattgaacaacactgtgaatgtgtttaatgccactgaattgtacacttaaaaatggtgaaaatggtaagttttatgttatatttattttacaactaaagaaacaaatttttaaaaaatgtttgaacttagaagaaatcgatccaagaacaagaagtcagcagccaattattgagggctcttgggaaccagagcacacccccattcattctatcagtggatttcaaagtgagtatgacatttagggaaataaagatgccagctttaataagacctcagctcattctttacccaatggggtcatttattcctaaatgcacagtcaggatagtacaagtgtaatgaattcagtctgatgaagatgatggcatgggaatattggaaactgacaaatttgagtcacccggttcaaaagtttttagatagacctataagaaaattgcacctagctaggaaattgcctagaaaagattttttttttttccttgagtttctggaaaatctttccttgtaagagctcagttgttcctgtgatgaatgtatattttgcatctttctggagttaagcacaggcaagctgaccactccagggttaatgctttgacctgtgctttgcctctccattatttccaacaacacttgctaatgaaaaggggcctgcttggtggtcttcaggctggacacatatccccagaatggtcaccacacagatcagtgttactttctttaaaatgaaagttattctttttttttctgattataaaattaataatgctcactgtagaaaatctggaaaatgagaaggaatctacttggtgattgaattatctttctctctatatagctatatgaatcacactacatataatcttgtatccctttattttttaactttacactgcaaacattgccccacgtcttaactattctttgaaaacatgatttttaatggctgtccaaaattgtatctgtggatatgtgattcaatatgatgaatgcgaatatggaagtctagcagaaacttggttctgctgtgagtctgtgaggcaatgatcttgttcatatatgcatagaattcttataatgtggataatatgtttataacagggtttgatacaatgatgtatccctagatatggcagatggggtcttccctaataagtggcttctttcctggtagctgtacctcttctagggaaaaggcacatcgttttctcagtctgaaatctgtacctgagaaagtcctggggttggagggaagggtactattgcagaggaggactccagctctctcttcatcccacgcaaggttcaaatttccaagaaggaacatctagcaggtgaatcaatgccatctaattgtttcagctagggcttgcagatttgtaccaatttcttgggattacagtgtgaagatcagaggccagagtgaggccatagacgggtaagagaggctggatcaggacagccatcatcagagcacacactgtgcctatttctagacctttaaattgtctatatttcctaactagtctcatcagaattaggcaaagtgtcctgaaaatttgaggcactaccacgtcttctaaatgaactgacagaagaagtcttgctcacatgtgaggaatgccaaggaaagaaacaaagaaagaaataaataaacataaaaatgggagagatgaacaggtggagcagaggggatttttagggcagtgaaataattctgaatgataccgttttgggggatatatgacaatatacatttgccaaaacccatagaactatacacaacacagagtcaaccctaatgtaaactatggactttagctaataataacaaatcaattttggttcaccaattataacaaatgtgctgcactaatgcaaggttctaataataggggaaattgtgggaggaaggggcatgtgagaaccctgtactatctgctccattttctgtaaacctaaaactgctcaaaaagatagtctattaattaagataaaaaaagaagatgcttgttaattaaccctgaaccatttatttagggtcgtttcattaacaaggagaaacgaaataattcacataatgtgtggaaggagaatatggggcaaaggtgatcaaaacaaaacaaaaacaaactgaggcttttctagaaatctacccttatgacgaaaaaaaaaaaaaagtaaaaataagataaaatcaaggagaggcagccatacctacccccattcagggataactagaaattatgcgagcaggaagagctgcttaaccaggtgcctttcctttcctggagattcttccccagagcaatatcttaaagattcctagtagacttctaataaagggtgggggtggggttgtttgtggcaaagcccccacctttccggattcaaaaggattgttgtcactcaacccattcatgcaatatactctttatctatacttcagtgctatgaggaaatgctcagtaccaggagtcaattctctttttgtttctatagttattagtctcttgtttggttttccttcctccctccttccctccctctcccttttcttgtttctaaattaaagcactgggttccatttttcccaaagcaagtcttctgaatttacagccatacataaaaaataaagcaaacattcttatttctagttaggaagagaaagaagacagtgatgggggtttaagcagcatcatctcaagatgaaaatgaaggcgactccagcctgctttgaacagaaacagtgaccgtggtgggttagcttattatagctggtcactaagtcaatagcctattgctgtctacttctgagttacactctgatggtttactcacatctccactggtgtatatatcccatggcagctctacctgtgagacgtcacagttgataggaacatggaccacgctgagggaccaggctggaccattcatttagatggattctccaatgaaaggcaccctttaaagaatttgctttagccatctacaggaccagagagggcaaatctgcccagccaagtaataacattaacattcctatcttctgtctcctgctcccaccctatgctttgacccaggcagggcccaaaatagcagtcagtagtgggagaagaaggaagttgaggaactgaggaggaattctgccatatctccatggctccattcccctgaggcaaatagcccaattgtagatcttagcacagcagagaggtcgggggcaaagggacagggaggagtcttatttttggaaggttattattttggagtgaattctccatttcattctcgttactgaaatgggactttttttttttgtggagcttaaagtgacatagactattaactgagagtgactagaaaagccacactggcaagaattttatcaaagaacaaagggaggaccactgcactgaataagttctttaaagggatagcaggagacaaagaataaagttgcattttggttgctgcacgagttatgcccactgataaagcagttacatgtacgtggctagatttgtttttaaaacttactctcggctattttgaagggactggattggagaggggaaagagcgaagttaggaatctaaaaattggagggtgttccagtattccagttgagacatgattacagaaatgacagtgaagagaaatgaaatccaacatgcaatagaaagtgaaagcaataggatttgaaggattggttgaaagtaggggtgggacagaggaaagtattaaggatttttctaagtttctgagcaactgggtaaatctcagcacaactgtgagccagagacctctgcaagagaagcagatttggtgtagggaagaaaggggacctctaataaaaccaagccatagctggttcctgaggctatttaaaaatagtcttccaaagagctttctttgaggtatctcaatgaacagaaggcgagtgctggaatctgagaagtattttaaaaactgacatatgtgttggctggacttaagctttcatttagcttaggagcaacaaatatcttggaacatctccatatcatgcctagttcaataaatctggatgggttctgatggaggaatacatgtgatctctctgacggctgcttccccagggaaaaccttgcttttcaaagcagatgatgtttgcccactcttgccaataaatgccaacttctacatatacgattaaatggcttcagagaactttggaccatgattgtgaatagccatgattcctggcagcaagcagggaagctgcacattcatctttcagtgttcagagcagaaccatctgtctaaagccacaaggccttggtggacacaagcagctgtgaacccggggggctcgttcatctgaaccagactgttgcagatgtttgcagctgctgagagcccattctgaaactcatggcctccattcaattagggctggtcagtgggatgaccctgaggattccccacatgaagtaagacccacttcttgcctgtgcacagctaatatgaggattaggtttaaaatgtcagactcttgaacaaaagtcagtttatcttggctcctgctactgaggttatactccctatggccttggatttagtgataaagaaccagttacacgtggtgcagttttcaaagtgctgcctcactacttaaatcagcaacataaacacaaggtgacacggtcatgaggttttttcctccccaataagtcaaatgcatgcaggccttccaagcagctgcttgtaggaattgctgctcagatcttcagaattcttatataaaatgagaaagaaatcccgtgagacagtttagctgaatgatactctaaccgcagttttatttattttttaatttttttttttgagacgctctgtcacccaggctggagtgcagtggtgcgatcttggctcaccacaacctccgcctccggggttcaaacaattctcctgcctcagcctcccgagtagctgggattacaggtgtgcaccaccatgcctggctaatttttgtatttttagtagggacggggtttcaccatgttggccaggctggtttcaaactcctgacctcaggtgatctcctgcctcagcctcccaaagtgctaggattacaggtgtgagccaccacgcccagccctctaaccagattttaaaatcctatggaataaaggaatttttagaagatggctttatgggtgtgcataatatgtaaagacaaatatgacagtttctctcaaacataggttaaaagtgaaatggtactgtttgcttttagaaaaattataaaatatgatttaattaatgtcaatttcctgcctctgaagatggctctaaagttatataatacactaacattagcagaagctgggtgaatgatatatgggaactatgtactttttttttttagaacttatctgtaagtctaaagttattttcaattataaaacataagaaaaaataggaattggagtctctgagtcttcccattcattattcttctctgtgaaagtgttctttcccgtaaaaaaattaatctggtcaattttagatgggattattaaaaaataaatgagaggcacttacattttatatcagtgtaaattttgcgttaattgtctcaacaggctagcagagccccatcagctaactgtgtgagaaaaatcctcatttctcacttccaaatggaaaaggtcctagctaatttcaatggatttggctttagatctaaaaacaactgcatcctctggggatgaccaagcagatgtgtaagtgtccccttaactgaagagctgttgctgaggaaaataaaatttcatcacatctggttctaaactgcaatacgagtggattttatcactcatatagatttcaatatggggtttcgtgcgtgtatttatttagttagttcacacagacatatgattagatttgcttttcacatgctttcacccctggattatctgtaggtaatcctaaaaggaaaaacattcaaactttgttggtatctgggcttgcaatatgtttttgtcctctcattgcatgataaaaaatgtatttggggttaatacaatttcctgattgataaaatgattttgcagcatatacaagtattattgaattctgaataactacagtttaataaactcatggaaaaggtttggctattgcagttaagcataaagatttcccttcatgatctcgtaggacctcataccttaagtataggtatgcttaaggatcagttaacaagagaaatctagtaagtggcatatcagggaaaaaagagcttttctttgaaatggcaatagtagagggacttcagagaatctggtctaatctccacgtttgggatttttaggaagtttaaaatggctggtgcttaatttgatggaggggtgggctgctagattcctttgacaacctgaaaaagctatagatattctacctataaaacacattcttaaagactttagatatcatttggaggttctgtggaacccctggagtaatttctttttaattttttttttttttttttttttttttgagatagggtcttgctctgtcatctagtctggagtggaatgccttgacctcctgggctcaagtgatcctcctgcctcaccctcccaagtagctaggactacaggcatgatgtaccaccatgcccagccaatttttaagttttttttgtagaggcaggatcttgctatgttgcccaggctggtcttaaacgtctggctttaagtaatcctcctgcctcagcctcctgaaaagctgggattaccggcatgagccaccacggctagctcatctttcctttgcttttcttcgtaaaacagaacaaaagatagccaccactccacgtctgtaaatgtgcttatgactactagaataagcaggggacacctgttaccgttagttacatctggagtttagaactggtgtgcgattgaaggggagaaagaaacaatgttattgggattttagacacctgggattgcttaaattattaccatgaagatacaggatgtattacttttaaaactcaaatgccggcagggtgcagtggctcacgcctgtaatcccagcactttgggaggccgaggcaggtggatcacgaggtgaggagatcgagaccatcctggataacaccgtgaaaccccgtctctactaaaaaatacaaaaaattagccaggcgtggtggcgggcacctgtagtcccagcaactcgggaggctgaggcaggagaatggtgtgaacctgggaggcggagcttgcagtgagccgagattgcgtcactgtactccagcttgggcgacagagcgagactccgtctcaaaaacaaaaggaaacaaaacaaacaaacaaacaaacaaacaaaacgtcaaatgcctgaaatgcatacatgagagggaaagaaaaagagagacaccctgtgctttaaatggaacaataaagtttcctttgagtgatcttattacagctcctctgctcacagcctccctgtgcccagctccaggaatcaacaattctcttccttgggatttaaaaaaacactttctaagcctctcagcttctgctgagaatccccaagggaaaagaaaaacaaaaatgctagtactttggactctagcagcaaagggatggtgaaaaaaaccaccgtttattgaggactcacaagtactttacatacatgagctcatgtgatctttacaccaaccctctggggttagaaaatagaaacacaaccctttggccgggtgcggtggctcacgcctgtaatcccagcactttgggaggtcggggccggtggatcacaaggccaagagatcgagaccatcctggccaacttggtgaaacccttagtacaacttggtgtacacttagtacaacttggtgtactaaaaattcaaaaattagctgggtgtggtggcacacgcctgtggtcccagctacttgggaggctgaggcaggagaatagcttgaacctgggaggcggaggttgcagtgagctgagatcacaccattgcactccagcctgggagacagggtgagactccacctcaaaaaaaaaaaaaaaaaaaaagtaatacaaccctcttagcttaaatcaggaagaattagaaaccctcaatagaccaaaaacaagcagcgagattgaaatggtaacttaaaaattatcaaaacaaatgtccaggaccagacagattcacagcagaattctaccagacattcaaagaagaattggtacaaatccttttgacactattttgcaagataaagaaggtaccctccctaattcactctatgaagccagcatcaccctaataccaaaaccaggaaaaaatataaccaaaaaagaaaactacagaccaatatccctgatgaacatagatgctaaaatccttaaaaaaaatactagctaaccaaatccaacaacatatcaagaagataatccaccacgatcaagtgggtttcataccagagatacagggatggtttaacatatgcaagccaataaatgtgatacacataaacagaattaaaaacaaaaatcatatgatcatctcaatagatgcagaaaaagcatttgacaaaatccagcatctctttatgattaaaactctcagaaaaatcagcatacaagggatatatcttaatgtaataaaagccatctatgacaaatccacagccaacataatactgaatggggaaaagttgaaaacattccctctgagaactggaacaagacaagaatgcccactctcaccactcctcttcagacaagagaaagaaataaaggccatccaaatcggtaaagaagaagtcaaactgtcactgtttgctgacaatgtgatcgtttaccttgaaaaccctaaggactcctccagaaagctcctagaactgataaaaaaaaattcagcaacatttctggatacaagattaatgtacacaaatcagtagctcttctatacaccaactgcgaccaagcggggaatcaaatcaagaactcaaccccttttacgatagctgcaaaaaaaaaaaaaaaagacttagtaacatacctaaccaaggagtcgaaagacctctacaaggaaaactacaaaaccctgctgaaagaaatcatagatgacacaaacatatggaaactcatcccatgctcatggatgggtagaatcaacattgtgaaaatgaacacactgacaaaggaaatctacaaattcaatgcaattcccatcaagataccaccatcattcttcacataattagaaaaaacaattctaaaattcatatgaaccaaaataagagctcacatagccagggcaagactaagcaaaagaacaaatctggaggcatcacactacctgattttaaactataccataagggcatagtcaccaaaacagtgtggtactggtataaaaataggcacatacaccaatggaacagaatagagaaccagaaatgaacccaaatacttacagccaaccgatcttcaacaaagcaaacagaaacataaagtggggaaaggacacccttttcaacaaatggtgctgggataattggctagccacaagtaggagaatgaaactggatcctcatctctcgccttatacaaaaatcaacttaagacggattaaagacttaaacctaagacctgaaactataaaaattctagaagataacattggaaaaagccttctagccattggcttaggcaagatttcatgaccaagaacccaaaagcaaatgcaataaaaacaaagacaaatagctgagacctaattaaactaaagagcttttgcacgaaaaaaggaacagtcagcagagtaaatagaaaacccacagagtgggagaaaatcttcacaatctatacatctgacaaaagaccaatatccagaatctacaacaaactcaaacaaattagtaagaaaaaaacaaacaatcccttgaaaaagtgggctaagcacatgaatagacaattctcaaaagaagatacacaaatggccaacaaacatgaaaaaaaatgttcaacatcactaatgatcagggaaatgcaaatcaaaaccacaatgcaataccaccttactcctgcaagaatggccataataaaaaaatcaaaaaagagtagattttggcatggatgcagtgatcagggaacccttctacactgctggtgggaatgtaaactagtacaggcactatggaaaacagtgtggagattccttaaagaactaaaagtagaactaccatttgatccagcaatctcactactgggtatctacccaggggaaaagaagtcattattcgaaaaagatatttgcacacacatgtttatagcagcacaattcacaattgcaaaattgtggaactaacccaattgtccatcgatcaacgagtggataaagaaactatgattatatatatatattccatctacatattccatctatatatttcatatatattccatctatatattccatctatattccatctatatattccatctgtatattccatatatatatatatatatatatatatatatatatatatatatatatatggaatactacacagccataaaaaggaatgaattaacagcatttgcagtgacccggatgagattggagactattattctaagtgaagtaactcaggaatggaaaaccaaaggtcatatggtctcactgatatgtgggagctaagctatgaggatgcaaaggcataagaatgatacaacggacttcagggacctggggggaagagtgggagggggacaagggataaaagacttcaaatatggtgcagtgtatactgcccaggtaatgggtgcagcaaaatctcacaaatcaccactaaagaacttactcatgtaaccaaataccacctatacctcaataacttatggaaaaaaagaaaatagaaaggtcagtaacatcttccactgacccagagcttgacaacagcaatgatcacatctgtattgggaggcctttaccatccatgaggggtaaccttgcacccaccttctccctacatggaagagcggtattctcacctccatttttttttttcagacggagtttcgctcttgttgcccaggctggagtgcaatggtgcaaactcagctcactgaaacctccgcctcccgggttcaagcgactctcctgtctcagccgcccaagtagctgggattacaggcacatgccaccacgcccggctaatttttgtatttttagtggagatgggggtttcatcatattggtcaggctggtctcaaactcctgacctcaggtgatctgcctgcctcggcctcccaaattgctgggattacaggcgtgagccaacatgcccggccactctcacctccattttataggcaaagaattgaggcacacagccctagagtgagttaagtgagagtagcataaagtgcaggtctttttgctcaccttgggtgctcctttcaaaccacgcagttctctacaaagcagccagagtagttcttttaaaacaccaggccggggggcgggggttacttcacatttctgctgaaaatcctcaactggtttctcgtcatcctcagaataaagtcccaaaaccttactgtggcctcacataatttgtctacctccaacttcctccatttccacactccagctgcactggcctccttgctagtcctcacacattccaaatgtggttccaccccagaaccttggtattcactcttccctcagcttggaatgtgctttctccagatgtcggagggtttgcttcttatgtcattcaggtgtggctccagtagctttcttttctgcccctactgtataaaatagcacccatcactctctagctgcttttcttcatagcacttatcaccacctgacatctatatctgattatggcctgcctctcctccccactctcaatgcagatataagttcaatgagagtgaggatttagtctttattgttctctgctgtgtcctcagtaagtgtcaaaacagtgcctggaacccagtaggggctccattaatatttgctgagtgaatgaatgaataaatacatgaatacgtgaatgaatgctacctcttttcagggcaataagttacaaatggaaaatagtgaggatcaaatattcaattcattcaacttgcaaatctggggctgatcttgcctttcaaataggtggctggctgagcaatttacatttcagctttcatttcccactatttcctcagttcattcatttaatcttccctgcaataaaataaatcaacaacccaccattaaatgcatagttcagtccaacttcaacgctttatttttagaggagacttttacaatagaggcatttggtaaatgtgaaatatgaccaacacctatcttggttccacctctctaattctgttgatatagtctgacctaggtttctagacaccctatggaagttaaagttattaatggaatgcaaccaagatgccatatttaatcaagatagctgaagacagattttatctttgttttcatgcattggcaatatgtagttttatgtgttgccaacaatttgaggggagtgatgcacttcttaagctttttgtatgacacttttcatgagatcagtctctgatgaatattaatgactttcaaaaaaattgtatctggaagagacaatcataggtcttgttgaagcatgtataccacaaattgtactttgcttgtaaattccagttacagaaaaaatttatcaggagacactgtactgtgatctttaaaattattaaatgtacacataaacatttaaaagatgaatcttgaaaattagttttctatgtcctgaatctagacagaaaaaagctgggaatatgtatctggtatatcttgatagggtctggaaaaaagtgttgttcaatagtcaatctggaaagaaggtgaatattagacgaattatcccaataataatgagcatgaaatctgaaaatactacagagctgaggctttacttatgggtccacatggagagccagaaagaacgctacatggcaagtcaggatactcatgctgttcaataaagcaaacatttttagtgcctattatgtgttaggcactggccttgcctgtgactcgggttcagtcattttactacattgggcttcagttttctcatctgcaaattgagataaatcttgccctgctgactttacatgacagttatgacaatcaagggtgatgaatgaactgctaaacattaaaagtcttttggtaaatattaatattattattgcacataaatataacagttttacctgttctgtgaatatctttggcccccatacatgactttttttgtaatggcaatactcttttttttttttttttaacttacctaagatttaagtcacttcttgttgcaagcaagcaactgttggtatgatggctaaactaagctactctcaccttacttataccctgatccttaaagaaggtatggagcatttagtgtggagcatttaaagagggaaaaaaaatcaataaagttggatttatggttatctgatttctgctaatctctttagaaagcctaacacttgggtcataacattcttcacatgtgtaataactggtttagtatctgtcttcactacaagagtagaagttacaagaattgtccactctttcaaatacaatgccttcatatggcaggcaaaacacacagaacatacatatttgtttaataaatgaataaactgattgagactttatgttcatcagagaaagtatcaattatttagctagatcttattataagacaggtgctaagtgctttaacatatattaactcatttaatcctctcaacaactatacgaaggaggtgctaatctgcccactttacaggtgaagaaataaggacacagaaaaattaagttactttctccaggttacatagctagtaagtggtggaattaggacatgaacctagacaggctggcttcagagtctgtgcccttagtctcaaggcaatacagtgtaaatgtctgtgcatgctgactacatacgcatcttaaagctctggcttcctgacagttaatcatcactcacatagagttagcctcttgacatcccctatgcttaggtatgaagctgttaagtaagagaagaaaaatggaaaaaggacatttactgtttctgtggcttcttaaagacactaagactacagacaatgaacttagaagaaaaatgattaggctgatttagaggttcatcccaaacatcccaataaccatgaccaaatgaagccatgtcccaagacgtgctagccacggacacagaataatgtgtatgaggctcaaactgaaggcccaaagagatacacaggaacagggcaggtccccagtgagtcatttcagagcaattgctttttgctttccttctcccatttacttcatttctcatctgttcttatatgaatcaaaccccagaactgcgaggaagataaactctgagtgattcttgctattgccaaacccagtgaaagaaccaccgggggccaatcataaactgcatggggacccatgactactcagtcaacatgacttctgcccaatccagtgggtgcgcagactctacaaagggcaaatgctgatggtgagcttaatgggataatgcaatttgtactggccaccgagcaaagaatataccagactggaaagccaatctgccaatcaactcatacatagtaagttcctaccatttgccacagattagaacacaagagttatgttggtgcatcagtagtagccatccatgttccatacttgtgtcgtaagaaccaaaactctagagagaaaccttccagaaactgtcctcaaccttccaggtctcttccagcctcttcccaagacagctgcattctgctctagggttctgtgaaatatgcctgtaatcttagaagtaaatttttctccaccacccataatttattgcttgcttgcttaaactaaactacctccagttagtttttgttacaggaaaatcctcattcaaagtaactgggggcatccaggcgcggtggcttgtgcttgtaatcccagcactttgggaggccgaggcaggtggatcacctgaggtcaggagttcaagaccagcctgaccaacatggagaaaccctgtgtctactaaaaatacaaaattagccaggcatgatggagcacgcctgcaatcccagctactcgggaggctgaggcaggagaatcgcttgaacccaggaggcggaggttgcggtgagccgagagcgcgccattgcactccagcctgggcaacaagagcaaaactgtctcaaaaaaaaaaaaaaaacaaaacaacaacaacaaaaaaacaaagtcactgggggcagatctgtttctaaaattcaggatttctcagaattcagaatggtgctgtgatacatatagtacccattacataacacccccagcagagcctggggcagcaccttggaatcaagcacattaataccttttcagggaaacatgaatgttcatattaagttagataaataaagaatacaaatagtttcatgcagatgaaaacactcatggttttcaggctttttctagacttcagaataatggattgtagtcctatatttataacccaaagtccaatgcagtgggcttatgtctaaaaggggtcaagggttcagtgtgttcattagaaggcatgaggctcttttgtcagccttctcttcctttcccttttcctagcatccccctccccaaggtatttccaaacaatgtatttcaagcttacattctaccatcttttcatcaatcaaaccacaaagggcctgaaatgagggactggaaaagtcataggtaaggaaggaagagtgacggcaaactgacttatccattagacgttagacgaaatagccctgattcacccagcagaaggaggagggtgctctgtttctttatggaaaagcaggaggagttgaatatttacacagtgcttaccacagctaagcctttaaatatatggtttcatttcatcctctcagtaaatcttaggaggtaagtgctactgttatcccccattttacctatgaggacacagagacttagtaagccaggaagtggcaaaactgggattccaacctatcctgtgttgataccagagcccacactcttaatttgtttaacttggtataaataaagtcatgtacattgagtgttactcaaacctaattttctcagttacaagcaccaaataggaaggaaaggggttatacgttttgttttgttttcatttttgcttggcatgagcagaacaggaaggtatagtgttggggtgcagggagaggtctaggggacatacactgtttttcaagcctgcatcagttgagatatcatgtgtattggcaaagcttatgcacacagaggtccaggcaggtgaccaagctactgtgaagtgaatcttttgtttgggcacacaatgctacccctgcagggatttctgaagctcgctccagagcgtcatggccattgcctgtcagagctctacctcatgcctagaagcagctgctgcttcttcaaaggagtccaggctcagctgatatctaatctcagaataatacatgacactgtccccccctgcccgactcagaatccaaggggaaaataatgagatcctctaggttcccccaagactcacttcccaggcttgcactatttccttttctgcagcctcctactgcctagacttggaggactggtttcagtcagaataatccccgcctcccacctccacccccatgtgcttaaaagcaagctctcagagttcatgacaagtacagagagatggagggtaatggaataggcgggatgcttgatttttcttgcagaatcccatgcttgtgtgggcaagatgaatctgcaagcacacactggattattctaggtgccaatttaggaagagaacatccaagtttgccatgagcaaaggcagagcaagggctacatgctctcctgaaagcagatcccagaattccagggcagggagtgaaaaatgcctccaaggcttgacttcctgcctacctgcatcagagttcagggcaccttgatgcagacctaaagcagtgctagttccattttttttcccacccaccagaaggccagggctaagcctccttagtacaacccatagactttatgttcaacaaaaggagaaacttcaggaactgatatagcccaaatgtgcaagcattcccaaagagcatctggttacctccaagggaaaaagaaatgcaagcaggcatgaaccacgtcacctgccagacaattcccatgtggctaacgtcaaacattctttcagagtgactggtttgaagagagatgtctgcaaggacaaggaaaagcttttcatatgcagccacctctctgctccagttactctagtagtgccttaatgtcagcccaggtagtcatgcctctgggataagtaggtacatagaaggcactaataaatctcagattttctaacaaactcgagagatggatttactccattgtttttttgtggctcatcttcccctagttcaaataaaaaaaaggaatgtgcagaacaataaagattctattcatattttttgccttgtctttgatctagttggaatctgtgtttcaatactgaatgggaaatgaatgcctttggaatttcagtcttcctgttcaaatttatttcccatcatgcccttcaggagccctcacagaggtttccttatcctctcttctgcctctttggtgaggcctttgcttccctccctcctaggtcaggctctccagcagtccctccaaccaagcccacctggccctatcttgcctattaagttggtttttacacctgtgggcctggctacctagcctgaacccaacccaatacttctggtttcactgagcggtgaccaacctacttccatccccagtttgttccagtttagtacctcctgggtcacactttaggcataatcccttctctaacagcagccactgcaagctgaatgtttggtctacatgtttattacaggctatccatgcattcagcagctatttactgaggggctgctatggactaggcatatcaaaacaacatggtgatgaaaaaataatgtccttgtgatcaaggagctcatgatctagtatatctgtgcttctcacactggaatgtgcacagagaccacctagggaaattgttaaaatgcagaatttgtttcagcaatatgatctcaggcagaggccaaagttctgcatttttaacaatttcccaggtaatgctgatgcaaatcatgcctgaagtacaacgtagtaagaaagcggttggggagatagggtgttcacaggggtacctctaacttagtccctgatattacagctgagacccaaaggatgaataggagttgtctagaaagagatgagtttgttctgtgtggagaaataagacgtggtagaggccaaaggtaaaacaaagtaaaaatgttgagtttccattcattgcggtccaaagcctaaacagaaggaagttattttaggataatttattgacatgacttattgccagggaagatggccactcaacaaaggtgatagctgcagggcatatctaaaatggctggatggcaggtgccatggctcccagctctgccaaagatgcctgtgctctaagattagcacaaatgctgcatgctcaaggggaccatgtgggctggaacaatggtaacccatgtagataagggactgggtgggttgctttgtattttggcactgagttaagtcctggaagctttaccaaagtctgaggaagggtacaaagcctgaataatgtctaagctggctttcccaccacctggtggaacagggactatactcagatatgttaaactaaggaaaataaacatgacattctgatcaccctcaaattttggttcttgactcatacatactttagaaattcaaaatggttcaatctatatgtaacccccataagtctttaggagacaccctgattttaggtcagtgctacaaatgacatgacataaagggaaaggcccagagttaaacttctagagcttctcataaatcgtaggaacaccctattacacccacttcaactaagaggtcttggttggctttacaactctcaataatgctctaagatgaaccacttggaaagcccaatgaaatatggccatcaaaacaaaccagccagctgcatagccccacatggaaaagtgtgatatttggaaatatctccatcagggaggtagtatatgcagaatgagcaataatagtgtctcacacagacaacagctgaaatctgatctcagaagtcatagaaaggaaaagaaaggggacaaaaccatcctaaaaatattctaatcacactcagagcaattcaaaatgataaatagctaagagaaaaatagattctaaaacaattaaacagaggaaacaaacagagaaactagaactaagacaatggctcattgtcttactgtgtcttagttcactgtgtcagttagtggcaggaggaggaagctgggctgggcactggagactgagaatctgggaaaaggagtactcagatggatgctgtggctgttgcatagacggagagcttgggccagcccaccagtggtgctggtggaagattgcctagtttcaaagttaccattcaaggtcacgaacttggaagttccataatactgagtttcaaggttgcccctcaaaggataagcactatcaccaggtaaaagcacagatggtgtctctaatggttactctgaaactaggtatcagagaggaggagcaaggatgtgctgagggttagaagatctaagttagtgtctgaggcagacagatcagtgcctgcagctcaggagcgaatgcaacgaagttctatggaggccctttgctccaacagagttccctgatggtctgctgagggtgccacttgccttctaagggcttcccagagctgttgcttaaacatttcaccctgtctgatcaatctctctggatttaaggtgacatcactactccttgacctggtactttcattctccacatcctctgccaggcacacctttttagtacaattagggaagcttagaggaactgctgaggccacaagggattggcaaccgagccccaggcttttctttcctgtgctgcagggatggtgctctccggcagcctctcatggtctttgattcatttctgactcccacaaagaggaaagcaggccccaaaggcaatcataagtggcaagtgctatggagccatggttttcaaattgtgctcctcaaagctttagggttctgcttcctgagcaaaggaagctacctcatcttggaggaccaggcggggagggtaggagtgcggactctgagcctttcacccactactgcagccaacgcagaaccaattttacttatttcatttaaggttctaagtcttttttttgtttgaaaaatataaaaaggtttgaaaccactaaaatagtgtgtctgcatcaataacatcacaccatattttttatagttaactgaaaagttaaagccaaggtaaaagaagaattcgtccaggcggaattcaaaggagatgaaaaattcctaaaacaggtcatcgtgaaacacaaaagctcatttggccactcatctggattcttagtgaggattttattggtggttattttaaagtattttctgtgaaagtaggcgcaacaactcctggttcttaccaccgtgacattaaccttctaaaccctcccgttcagatcattaaccccatgggattctgttccacagtttgttaagctgccatcctgcctgcttgggaaaaaaaaaaaaaaatcccagtcaaagatcagatttcacctgagactttaaagccccaagaatttggccaatgctaatttagacattttttaaaacaggttcctccacttgtaaatgactgcgattttgtgcagagttagaaaaaatgccttctgtattgggaaaaattcaattattttaaagataaattctcattttaaaaatgattttctacccttaaaacagtattctttatattctcaaaggaggagaagctagatcaccctacaatttaaaaataaataaacctcatgaattgtatccaaagaaacaaaagttaaacaaacatattcctcacttaactagagatgtaacatgtggttttattttagttgttaaagctaactcctgatctccttccaaacaggcctagtgacttaattaccatatttgaaaggagagccacgaaaaaaatggagacagggaaggagacagatgaatcttcttggatatttcttcacaagattcagagggagtccaatcccacaaaaaggacagccttaggcatcttctagaaagacaaagcctttcttgggagggagagcttgaccttaagtggcagcaagaatcaactactatggagataacatgaggaccagtgatgtaaatattccttgagaccaaggtacaacactgatgactgacagccacagaactctgtgtctccactctatcttctttcaggtccccttccagtctgcttttaaagttgtggagtcaggtgactggggatgtgtgaagctgggaacttctgggattctgaaatgcaaaacactggaggcagtcccagagaagaagagaaagaacattcttttccaaatgacacaagcagacttaagtaaatttatttgttcagaaaaggtcagtaaagtcatgcttttcccattaaaaattgtatacaactgatcaacatgacggataaacacaactctgtgtagcaagagacccaaggcatgttacaaactcccccaacacctctagcatatgctggaataaatgaatattggcctgggaagaaaagtaactttagaaacagtccaacatccattaggcagtgtgcttcacagaagcaaaagacatcagacgatcaactaccatgttcagaaaaataaaccagaaacttgcactgctaaataaaagtttaattaaagggaagaaggctatctattattaaaatggtcacagaaaagagtagtagatccaaggtttcacttccagtcatttccataaaacctattttgatcattcaaccagatagaagctccctcttcttttacaattctgtaagatttcttttttttttctctatgtgctgaatttctttccctgtgttgtagaggcagtaataattcaatcacagggttattgccatttgagatactggaataatctgcaaatgtaaaagttctattcagtattgtcatagtagtaaagcttttatttttagtagtctcttttcactttgagatagtaacctcaaggacaggaagtactttttgcttttctttctatgccctgcaatgccttatctcatgcccagcacatggtaggttttccgcaagtctcttttgaatggaactgcatctctgccaggtttgcacaccgctgatccttatcttccctcagaacaggtactgtcattgacaatccttttccataatagaacgttagtatttgagaggatcctggaagttgtctagtctcatcctttcctgcccaaaaatagtactggaaaaatgcagagatcctgactttgaaataatggtgggattccattctgggctatgcattttaatcagtgttaatgcataaccaggaagttcttactccacctgcttaatttcataccctcttgaacagaaaaatggggcattaaaggaatgctccaaggatgacatgaaaagaagaggagaaaggaagctgttttccatctttgctaaaagcacaaaaatattccccaattacatggaattctctattcatctgagagacagactgatgttagaaaatagattcaggaatacccttttctcttgagaatattatcttttctttaagaaaatcaacatctttatttcaggaactatttttttttttctaaatgagatttgctgattttctttttgcagcatgactttttttattcaaatatgaagatacatatttgatataaatttagtaccggctcaaaaagagatattaaattcagggctttgtaaacattatctcatttatgtatgatagtaatgattttttatatatgtatgtttttattatactttaatataataattttaaatcagaaattactccagtccctatctccccttttctagctctgaacacattttccacctatgtctgcaccatgctacagccattagcttcacccatcttaagcagtaagatgattttaaactgagaagcagccatgaattaagccacatagaggtgaaactgctgtcagatgtttagtagatttgagggtgcaaacttaatcatttactgtcacagaaatcagaaatgcaaaaaaatctttgagataaaccaacctcatgccttctaccttaaaaagagaattctctgccttcttcatggggccaaggatatcaaatgagcctacaaagctccatctccaccctccagttaatcaaatctgaaaaaattcctggaagagaagcagcgaagggaggttgcactgtgaattgtcaaggcctttagaattcctgtgatttatagatgagaatgaagcctttccatgcatattgaaggtgcatgggattcttaatttatggcttaggagttgcaggctacagtaataaacctgctaaactactgaatcactgccaagagtgacctttacagagcctgcagaggtcaagcagccttctccttgcgagtcaaagaattcttggctaaatcaaagctcttttggtttaagaaaagagaaaaccacttgagccaacagaagcaaacataagcaatttgataaaaggaaacaagagcaggaggtggagcccagcatcatgagggaatggaaatagaactaaaaaatccagactcagggtatttgctcacctctgtgaagatgcatggtagcctcatgtcttcttactacttctgcagactgacattcctggctttgtaatttggaatcagagatgttgattagatactgatgtagattagaatacccctcggaggacaaatgctgccttacaagtgtttttgctcatctgggctgtctgctgaccctcttgtgttgacctacaatatacttgtctttcctgcccttgtcttacttaatctttcaaccccctcctcttggcagcatctctttcctctgctcatgaataccagtctccactgtgttttctcttaactctctgacttctcctcaaactcctttaccaacaattcccctttctccacccaccattaaatgtggtgtgcctcaaagctctgtcctaggccttttctttctatgctttaacccacaagtgctcttagccacacccatgacttcagctgccatttatacggcccagccaagacctttttttctgaatcccaggcctatatatccacctgcttggtccatatacctacttgaatatctcagaggcacctcaaacccaactcatccaaacttcccaccctcaagaactcctcctccaagattctcaatctcagtaaatggctctactcccctgctcaagccggaaatttagggcttacctttactcctcctgctccctgctctacccctcacacatttcctcagcttgtcctcctaaacctctccaatcaacccaactctttccacacttgagttgaggctctcatcatctcttatctgggccactgcaaagggctctcagttggtgctggggctcaggaaaaaccaccccaaaacatgactgtaggagaacataatacaccactctaaaatatgtctcttggcatgttgactatttcaaactgattattttgaaaaactgtagacacaggcagagctctgaaaagtcactcttgtaagagaaatgtacatctaaaggaaaataccatttgtaaggtgtttctctctctctctctctctctctctctctctctctctttctctccccaccagggagaaagggatggttaaatgaggagggagggaaggcctagactaaaatctgcataatcttacccttgttttctcttttcctggccattttcccataaccagagtttccccacactccttttttaatttgtttcagcaaactatggcacaaacctgaggtttaaactatttttctttgagctctgctggagaaatgtattcatttctctggggttttccccatgtgtacataaagtatacatgtttataaacttcttttgttttcttttgtgtgtgtatgtgtgtgttttctcaggaagttccatttaagagctatgaaaggtagagtagagagaaaaattattttttctccatgacactgggcatccatccttgcccctccccagtctgtggccagagcaattcttttaacattcaagtcttaacatgtcactcatctgccttcagaggcttcctataaccctagaataaagaacagagttcttttatttatttgtttgtttatttatttatttttgagaaggagtttcactcttatctcccaggctggagtgcagtggcgctatctctactcactgccacctccacctcctgagttcaagtgattcttctgcctcagcctccccagtagctgaaattacaggcacccactaccgtgcccagctaatttttgtattttttagtagagacagggtttcaccatgttggccaggctggtcttgaactcctgacctcaagtgatccacctgacttggcctcccaaagtgctgggattaaaggtgtgagccaccatacccagccaagaccagagttctttctaagacttccaaggccctgctccctctgtgacttcctcacatgtcactccagcctcactcattgcacagtactcacactttccttcttttagtccttcagggatgcctcagttttctcacgtcaggacctttgtagctgttgttctaccccgctacccagaccccgtaccaccatcctatcctttctaccttgctgagtcccatttacccttctggtctcacctaaagtatcatttctaaggggctcctattagagactttgtgtatgtttggtaatatttgtatgtgagcttgtactttgtatattggcacactgcattttcctctgttaaacttttcacacttgtaattatttctttcacttgttcattcatcaacttatacaaagcactttcatgtgcctggcactatctaggcactgggttgcaacactgagtggaagagattcctacactcatggagcttccatcctctgtaggtcttactctactatttgcttttaagttcatgaggacaaggtcatgcacgttttgtttcccactgtgttccagtgtttcgcacattagctcactgtctggcatgtgtgaaacagtcaacaaatatttgctgactgtctgattggcctcccgaagttactactgtactgttgggtacatagtaagtaaatacaagttgaattagacaactgcttgcaggcaattgtgtccacagaaaatggcaatgcttcagacttgttatgatgatttgcattttatttgactttttagtaaggaattattgatcttcttatctctgttatgattaatataaatgaataaatatacatgacaaacaacttcagagtgaaaataatattaaggaaattaggcgggttatctaatagaaacagaagggatctaggtcacattatattggatggttagaggagtcctcccaaaggaaggagaaatttgagcggggatctgaatatgaagaaagagcagccagctatgcaaaaatccagggccaagctttccagacacaaggaacagaacgcgcaaaggctcggggaaagggagtagggggaagagctgggagtggggggaagacctgggggtggggggagtgtgttttgagaagcataaaaaagcctagggtggctgaagtccagcaggcaaggggaaatcctgaaagaggagatggcaaaagtagccaggggcctcctcacaaagggtccagtaggccaaggtaaggatttaagattttattctggttgtagtgggaagatactgcactttagaaagtagatagttaatatgatctatgttttttaagaaaataaattatttgctctgtgggaaatgggctacagttgtgcccttcttggcattaagacctcttagaatctcagagaccactagaggaaaaagtaaaatagttctaatgttctaaactctgacctatttgggactattatataattataaaggtattcattgaatttcgtcctttttggtaattttcaagtcctactaatgacaactttcctatctttattggacattgtgctaatcaaggggccatagctctgttagcacatttatttatttataagcaatccatttattactggtcattgatgaatatgacgaatataatctagctgatggacattaaaaaaatccaaaaagggaacagctgataaatgtctcccttcaactgctacaaagtgtgcaacactgtcaccagagccctccttttgaaactcactgatgcattttacatttgtcaaattcattatttatgagcagtgagctatacaatagaagcgagagtcatccacagggacacatctgcctgccttatatttgacagggcttatctccaagggaagagggcttcagttttttatcatgtcagttaaaaaatgtactgatgtgtttttaggctggaaacttcttcttaaagcatgagataatgactttgctaaatcctattcaaaacaaagacacacccaaaagctatgaaagcatagaaaccacattgctatttctcaaatgaaggagaaagactgctggactagatgaaaaggggcctcttgttaaggcttcccatgcaaatatgccaggatgcatttttccttctcatatttactaacaccacgaagacattgtggtacgaaccagtttaccttttagaagctggattcacagatggcagtaacagtaactataaatagccaagagcactgagaaatcttttaaggaaggtcatcgtcaccctaccgtatactactgcttcagcatgggcaaaggagcagagagttaaccttagagaaagctctaacagtaaattcagggcactagcagctggaaggtaactggattcaaagccctgttcctacccaggtctgggagctcttacttgctccttgttgaaattaccgtgcccagtctgagattgtgacaggcttcagaactgctactgctgaattggtggtaggaggtccccttcagctgaaggaggctcaggacccctgatacagccaagaggatgaggcaggtgcctgaaggagacctagcagatgggcaaagtgctggggcaagaggaccttgtaggtctatttattgggtaattttaacagttcactttgataatgtctccttgccagtttgttataaaggctacaatacttcatgtgaaaaacctgagctccagttttggtcatatttgttaaaggacattcctcaaagggcagctgctggatagcaccgttgggaggacaaggagctgcaagagatgaaacgtacacttgcggcgcctgaaataacatgaagtccaatcagccccgtgagtcgctgtagactgataagggcagccagattccacagccatttaaagagtcaacatgttttagggctaaaaaacttcatgggccccaaagtgtcaactccttgaggggtgactgagaaaccatggccgaaaagtccacctcagcagcaagtccaggaacctaccactgaccttacctgttgaaagagacttagggcctctggggtctttacttctgggagcctcaacggtttattgatatgtgtagcttctactatgggagaaaaacacaacagctcctttgcagaaatatggtacttacaatattattagcaataatattagtgaatatttattgaacattttctacacgcaaagtcccatgcattatcctattaagaccttacagcaacctgaagacctaggtttcctgaggttacaggggaggaaacaaggttaacagactgaggagtaaagaggaaaggcaaacagaatctacctttatatactggactggaaattaaatgttacagacattgaattatattggtctgctcatttcttaattgtgaaactacaaggctagttgtcatactctaataatcatttatttttttcctccttctcttcctagccggtgagacttttatctttaaaagacataccatacatacatacacacatacatatacacactcaacattcaccataaacacaaattattgaaccatctcatctgtcttaccttattatgggaggtttttaccattggcacaaatctttttagtttcagcagaccatgagtcaaattccaagtattcaagacacaatgagaaagtagcaaagccatgacttgaaatctctttatttcatccatgcaggatttcttctgcagggacctcatgctttggtgtcacagagaagcaaaaccttttgcttcttcaaattatccttttactttttccccctctcatgctgtctttgaatatattcatgtttgtgttttatgcaaaggtatgcatatatgtgcccagaatactcctatcacagatgtctctggcatagcaaaaaaaatggaatggagccagaaagacctactatggacctttataagctgtgacctgtgcaacatttgtaacctctccgaggctcagttccctcattgggaaaacaggcaaaaggctgttttgcctgtcatgctttgggggtgggcccggtggtggggggtaaggctgttgtgagaggtaaggtagcaatgtaaagcacctagttaacctacagtggagagaaaatggtagacatcattattacagtaactgtctaaaacaaaatctagatatgacaaaacctggttagcaaggcaggtgtaagattggtctcaccctagcagtaaaacacatttcatgtagcataagatgttctataaatcccattcagaaatgagtctgtccacagtgggcaatacatatctgcccatctgcaggttgaagcaatgtggccatgtctctttaatgctgactgatgttcaactacatcacagtgcccttgtcatggggctcagttaatgctgaattcaattatctatgtagatggaaagagcagagtcatagataataattctgagaacaaatactttctaaatgattccttcttttttttttttttccataatagctaccttactgtattacttgggtcttggctgatgtttggtactctataagaatacgtatcaatggatgatgggaagaaattcatgactactctgacctggatattatagaaagctctcctgagcctgaatatttgttgcataaaatttgcaaggtgaataactggtggtggtccaccactctctaatgtatggcacaataattataaaatattcattcaattttaagatattttctgtgtgtgtatcaagtcccaccagttacgcatctagtctgaattagctcattaggttagggtgaacatagtgctaaggaaatcagaagattcattttttttttaaagatcaattagcatctttcctttggtgctcccaaaaactctgtgataaggagaccacataactgtgaatactgatgtgaaatgccatcagtactggtgggtaaataccataaagcagcggtcctcaacctttttggcaccaaggatcagttttgtggaagacaatttttccacagcagggttagggttggtttcaggatgaaactgttccacctcagatcgtcaggcattagttagagtctcataaggagtgagcaatctagatccctcacatgtgcagttcacaatagggtccgtgctcccatgagaatctaacaccgccactgacctgacaggaggctgagatcaagcagtaattctccattactggccactcacctcctgctgtgcggcctgattcatgacttccaccaacaaatgtaatgtcttttctaccgtaactaagcacttaccatgcactgtggccataacttttgcagtttgagaggcaacaagaaaattagcataaatttctttttacttcacaatttcacaggcagaagattcataccatagatctgagcaaccttagcctacaatttttttctttccttaagtccttatgttcaccttttcacttaaaggaagcactttatggcttctctttggcatatctgaattgctggcatcactactcttgcactttggagccatcattaaggaaaataagggttccttgaacacaagctctgtgatactgcaaaggttaactgataacccagatatctactaaatgagcaatgggcaggtagagtctacagtgtgggtatgctggacaaagggaaggttcttgtcccaggtaggacagagcaagatttcatcatgctactcagaacagtgtgcaatttaaaacttatgaatcatttatttctggaattttccatttaatattttcagaccacagttgaccacaggtgactgaaacagaggaaatcagaaccatagataaagggggactactatattgtgaaattcgtaatgcaattgtcgcttgtcttgtttcaaccaacatagtctagtgcctactaggtacaaaggactccctccccaccccagcagtgttctcagtgttgtatggatccctaaggaccctttcaaaggtacacaaaatcctcccctttccaaccacatactcatgtcagccctgacatgaatcaaaacaataaaccacaatagactgaaaatgcagaagcggatatgagtccagttgccttctgttaaaccagacgttaaagagatttgtgaagagtaaaacaatattactctctttactcaaaaatttttttgttttgggaaatgtagttatttttcataaaaaaagttattttgttagcatgtaatgggcttattactttctcaattaataaatatttttaaattttcctagttttaatttctaatattgttagctgttgctagatatgacccacatacacaaaagatcaggattttcagtaatttttaagaatatgaaggggttctgaaaccacagaaaatttgaggagcactgactgttgttcatctgtcttatttaaatcttacagcatcctaattccgttttcctactttaattgtcttcatagaacttatccttatctgacattatgtcatatatttatttgcgttttatctgttttctccataagccagttatttgcctacttgctctcagatccgttctctatctttcctcagcaaaacgtgtttcccaggctcctttgccaaagacagtgggaagcattggcaggagactggaggagggaagcagacagccaggtatttctacctcccaccctgccctttcgggtcaggcagtactgctattcaccttggctccaagggacctcccctctttgcccctggctcctgagccctggtaacaccctctctgacttccctcatgcaagcctaaggtggcagtggcttccggctcttgttataatattatattgttgctttgccagcccagtttgactttgagctctctcagcacttttgtgctagttctccacgttagctcctttcattgcaccatctggcatggggcctgttttcctgactgaaatgtaagttccatgaggtctgggcctgtctcatctgctaccataaccacaatgtctcaagtaaataattttttcaaagtaacagccctgtgggataagtgttagtatcattattttatatatctgaaaaataaggctcaggcagaatttgctcgccccagacaagtgggtctcaaactctagcttgaatcagaattacctacagagctttaaaacacagatttctgggccacttccagaatttttgattcactaaatatagggtgaagcctataactgcatttctaataagttcccaagggatcctgatgctgctggtctaggacccactttgagaactactgccctgcgtgacacaactgaaaagcagcagggccagtccttatgtctagtcttcccactgcatcttgaagcttaagggtatttgacaccaagctcaacagtcaggaacgtgccaccaaatatacatcaactctcccaatagctcactctgggactgtagtccagatctctattacattattcatcctgtactctattatttgtagtctataccacactgaaagtaacaagtttttaagtttccaaacatacataaacgatttcttcctttcttttactggtctatcactgaaccttctcaaactgcgaaaggtattcttaaatatcaggatttagttggggaaaatacccaaccatatttgccatcttccctttatgattttacagcttttcactttttccctcttcctgaagaattcaagttagtccaatcaggaacccctacttttcaatttcttaatcatcttagagaccataccctggaccgtcttctattctcatacacccaccttgagttgccccaagggctgggcactctgatttcaagactcaccatcagggttttgataagaaggtaacattttggtttggttttagcatacttcctgatcatgccccaatagctttattagccctggtagttgttagacttcagaaaaccaatgtacacatgactggccttctccttgggctgtcaataattatcctttcagaacagtgaagagcatgaatggcatatgtatgatacacattctttagtcttgcacctatgcagatatcataatcaaccacagcatgttctctctgagccccatctaagaacattatatggcataatatttcaagagcacaaggccatggcagatgttctgcacctcctgtgacattccagtaaatggaaacctctgcctttgcaacccctgtcctctgggaaaagaaagaaagagagagagagaaagaagaaggaaagaaggaaggaaggaaggaaagaaggaaggaaagaaagaaagaaagaaaaagaaagaaagaaagaaaaagaaaggagggagggagggaaggaaggaaggaaggaaggaaggaaggagggagggagggagggagggaaggaaggaaggaagaaaggaaggaagaaaggaaggaaggaaggaaaagataaaataccccacatcaacctgctttcttccacctcttcagatgtcatttgtaaatggagctcgggtattagaagggaaggcagtaaattttttcaagttaatcataaagatatcttcacaagtacatctgtactttaaataggtacatatatgaaaaagtgggcctaaatttttctacttgaaaagaaatactttatcccaatttaatctttatcatttccagaaaacagggaattatagacactactttcatcttgtttttaagttattatgtttttagagagaggaaaggttataatttcatcaaatgcagcttaaaaaactctgtagctttgtagttaggcaagtctggattctaaacctggatcaaccacttactaggagggtgactttgaaagaagaaatttatctcagtttcctcatttgaaaatagggataataataatgatggttaaccaggactgctgtgaggattagaaaaaatataataaaagacctagcatattgcttggcccagaataagtaataaatgctagttaatataattattactgtattttaagctttggaattaccaccttattttaaaagtggaatgtatcactcttagttggtattcaaattttgatcaactgatattctaatggatgtaaaaaattatttcttttctgagatcactggaactgtgacatgatcaatagcgtctctccattttttcttcagctggtaaataaatgtgcaaaggtactgaaggcaaaattctcctatgtaatcaagcagtaaaagctgtaataaatcagaggtttttcctttttatatcactttgaaaagggaaattatgctaaaattttttcagcatttaattctctaccaggaacatcctaagcactttatgtgcattacgtcacttaattctgataaccttacaaagcaggtattattatttttcccacgtcaccttctagatggggaggtagtctcagagaagttcagggtttgccaagcttacatagggagagcttacgtaaggagaggagcagatttaaatcagaactgaagatgagctctgggactttacactatttctggaaaacagaaaaaagccagcagccatcccatgtgccttgacagctactgcccacaggtagtttctagcgactctggtacctcgttgacacatttgctcacatttctcttcaaaaacatgggaagacaaatgcccctggctgcaggctttttcttttccactttgagatgccaaatatggatggcttatctgagggccataataggtaagtccgcaatatttagcaacttcttttcttcctgttaactgtagtagaattcccaggctgggtcaagcaatcaaggaggtattgaagagagtgatccacaagtaattctcagtggtccccagacactgaggccccactgtgctgtcacatcaggcattagggtaatcttcagctgcaccagagactaagcaggagcctcccattgccggcggattgtcaagggatatgatccagggggtgggcaacacaatgaacacctgactcttggctgcagcttctcccttaattcttcgctgctctccagtcctgacgacctgggctggatgatgtagaaacatcaaaagcctattgctgcttttgaataatggttatttcttttcctgagaaagaactaacaactctggctccagtctctgtgacgacgaatgttttaatcacaaaaggcctgaactaaggttcagttagacacatcactaaggagatattcacataataaaaggcctcttcgccaagttttgtttaaatattgaactctcagagaaatgaagatgttagccaagtgacaaaaaattcaactgcctcccaatttttgggaatacatctttttttttaatatgaactatgtggcatccttcaattcatttacacttgcactacagtagtagttcaccacgtgtctactttataccgaatgttatgctgggtgctgcatcctgcagcagaaagaagatggaactggctttgtgcaggccacttgtgctatgcctgtgaaatgccttctaaagttctattagagactccttcctgattctagctgtcaaggccaagcaacgccaatctcatcccatgaatgtctacctttcctttcatttgttccccaagctatagcaaaagatgaagggaacatggatgatcaactccacagccaaatgcttgagataattatggacttttgatccttagttctttctaaccttgatttacctgatgagtctattgtatcacactgaggctgtgatactgagggaactaacgtttaaagcttactgctctatgtcctagcattgtgtcaggggcttcacacgtagcatgttattttatattcttaacaattccatgaagcaggtacctgtatatgcattttacagatgagaagacaggctcagagagactaaaattatgctagtaaaatcatcatcagaattcaaactcaggtctaacagaaactaacacttctgttccttttaactactccatccccttcccaaactagctagtcttcctagagcatcccatttattaaggggaaaatatgattatgtgaaagaaaatatggacagaattattcactagaataggaaattagcatgaattttttttttaagatataacacccaaaggtcctgtctgcagagacctttgcagataacacacgtccttatgcctacaaaggttcgttgaaggaaaagcttgtgaatcactttccacacatgggggtgtaaggcaggctaataatttggccttctggcaaaatgacatcatataagtatctgcatactctctatctagaggcaaggcagggcactggtggggagggcagaaagaagccctctggtgtcagggccctgctgatacaccccttaaagcttgacacttagacagcctgcctctccaagctctactgacctccacagtacaggcttcgttgactaaggaaggatgccatggctacaaatgacaaatgacgaatggaataaaagcagcagatgcccccatccccaccctattatggcctttgtttgtaatctctggcttccactgaatatcacatatcccatttcccttcccagctggtgctgagatgtaacaacttgtcacctgagatacagcccattaaaattacatagcacaggtaatggagaatccagtgcaggtccggacagcaggtaattagctgtaacttacagagcagtcttcaggccctctaagggcctcctgcctttactccccttcctttctgcttctttgcacactggaggccctaaacagaggtatctcttgggatttgttgagcaggggtggttatttaacactgttctcattaattcagccaccaagtcattgcagtattgggttcacaaggttgtggtggggaactgtgaccatcataatagaccatcaattctccagcagccagtggggtgcagggagtggattcagctgtctctgcatgttttccaagaatagacaactgaataaacttgggtagcatcagaatctacaggaggcaagttctttaaaggaacagaatcttagagttcctaccagtaagggcccagtagagtttgcatcaggtgcagggccctgggttttttcaagtccctctctgtggtggttttgtctcaaggcatcccttcgagaggatttaacatgtactgcaacaggcagggcaagccaagagtgatgttgactctggggtaagaacaccacagacatgagatgttggagtcattgacagcatgggctttggagttgagacaccttgggtctgaaactcagttctgcctgtgtgaccctggcaagttacttaatccttttgagtcttagttttctcatctgtgaaatggaaattatactacctgccttacagggttattttacagattaaatgacataatgcaggtgtattagtctgttttcattctgctgataaagacatccccgagtgggtaacttataaagaaaaagaggtttaatggacttacagttccacatggctgggaaggcctcacaatcatggtggaaagcaaaaggcacgtcttacttggcagcagacaagagagaatgagaaccaagtgaaaggggtttccccttgtaaaaccatcagatcttgtgagacttattcactacccatgagaacagtatgggggaaagtggccccatgattcaattatctcccactgggtccctcccaccatgcgtgggaattatgggagctacaattcaagatgagatttggggtgggacacagccaaaacatgtcagcagatgaagtgtttaaggtagcaagcattcagaaaatggcagctttattcatatgccttcccaactggtaaattcttaggaagccaaacagtttactagatcccacaggtggattgaatttccagagtcttggaaaaacttgccagtgcatgaggctattatgggggctctgttattgcagtgagtactctgcaaacacttttcccatcctcttgaaggatcaaatgtaggtaaccttgcccaacgttattttaatgagtagcttatcccagatgtgactaataggctatctccccaattctcctgctaacccattcctaccctctgctgaggttagctggtttgacactggacatgaacaggtttagtattcagtcttctggaaatcaagtgagaagacacttcctagtagatgtctctctagagttagatgctcatctgtgaagccaggagcctaaagaaatactggaattttccaaaggctctgagagatgtcaacctgaagtatttataaccctcatcacagagtgattcagcaatgaagactgatgatttttaaaaatcttgtcaagtcttttaaagcacattttattttactgaggatacggttcaaaaattgtctaatagtctccaagagttttggttggcagttaaaaagaaatgtatactgagagagagataactaacatgtatttttcagcaactcttatgtctcaggctctgggatgggtgtttttattcatactgcttcatttaatccttacaacagtcctgtggaggtcacagttataacccttagtttacaaacgaatggaaacttagagataaagtcacacagcagcttctaagtgacagagctaattgattaagcccaagtctatctacaagtccagtactaattccaacatactgtaaatatattttgttgatgcccattctgtcttgctagcgttacaaagatttctatcaaaataaaaaccatgtgagagacatacaatagaaaataaaaacttggctgggagatgtcgctcattatctgtaatcccagcactttgggaggccaaggcaggcagatcacctgagatcaggagttcgagaccagcctggccaagatggcaaaaccccaactctactaaaaaaatataaaaatcaaccaggtgtggtggcaggtgcctgtgaccccagctactcaggggactgagacaggagaatcacttgaacctgggaagcggaggctgcagtgagccgagatcatgccattgcactccagcctgggcaacagagcgagactctgtctcaaaaattaaaaaaaaaaaaaaaaaaacttaaaatgtaaaggccaatcataaactcaactccccaacatcccatgtctgagaagattatccctatggttgacttgtttttatattttcagatcccttgccacagcatgtgagggaggatgagactcagctgtagtctcatcggaaaggttaccaaagggatgcaactatttccacaatgcacttgaccactgaacagactacttactttagaaatatgtacagaatcaatttagagcaactagacattctggacattatgtaaactgctcaagaacaggggttctgcctgctttgttctctcttggaacctaaaataggtgctcagcaaacactcattgaaagaataaattaataataaatggcattaccagggagttatgggccagcagagggttttcatgaggctaagtaatctgctgcccagtcttagaatggaatgaaggaatatttacagtacctggacacagtcctcaggcatttcagagatgattaagaaataataataatcaaaaaaaagaatcctttatctaaaagttctagccaaaaaaacaaaaacaaaaacaaaacaggtcttataaaattttctccatcctaaacaacctcctaaaaccattcattgaaaagcctttaccatgtgaaggggaatctgtgaaataataatacatgctatgaatggcagcataggacaaaggcacagatttctggccagacactcatgagctcagaccctgactcctaaatatgtattagctgtacaacctaaggaaagcccttcttcagcttgtttaaatgtcagcatcttcactggtaaaatgagatattaacttcatttttactttattgggttgtaagaattaagaaacattaacagtagcaggcacagggcttggtatttagcaggctcaatagatgtgaattccctccctcagttccctcccttgctttctttgttctttcctgccctgacacccacttattctaaaaccccagaggtaagtgagatcatgtaattgttttatacatgttcttattccttcttttcaaagacttaaaaaacccatgagttggaggacctctaagtttgctactggcttttttctatcaggtctaaaatattaaatcctattatataacagaaaaacagggaagctgggggatggaccataaaaattactgtaattagtcaggcaatagaatttttttttaagtcatggctttctattttactgtcttggctgtgatgtctaaaaatggttaaagaaatataattgaaaaggaggtggcccttgcttcagaatttactgctctttcaagggctttcacagggacatctgttgggtttgtaataaaagaagccagaaaaggtttcaagagagagtaagggaaactatggtttacaaggtatccacatctgtttggtattctgccatctgagaaagttcgacttctgaaatagcacgggtcacctagttaagactgaatctaggaacagatgaaagctttctttcctcaatgtttcaatggtagagatcaacagctgtttatatcctttaatagctaactaaggatgaagctttcacatctgtcagtattttccggttctatttccttggatcacagtggggaggagatgaagtttgaacccctcccaattcccaagcagaaatatgcccagtattcaaagctgtaattctaagcagaactctccatttctcatccacccagggtcctgtttgcttagaattcttcttttgctttaccctgacagacatcttgattatctccatgataatgactcatgatagcacaaagatcaaaaagaagaaaagtaggctggagtcaggagaaggaaaaagaggaggaaatggagtgtaacagagaaagtagctcctaataatacgttcttccaaaagaccacaacagtagcaactgagggcaaatcacagaggtgagcaggaggttgaagactctcatagtgaaggtggacggtgatggtttttactgaccgtaacatctcaccttggaaaagttaaacagagaaaatggaaccctatggaagcaaggtgcaggaaatatccaggaatgaaaacaaaaggattcagaaacatttgtttaactttgctctgatcaccagaatcatccatgtgctgggcctttataaagattatttttccatccaaacatccatccacccacccgtccatccatccatccatccatccatccaataacttgaaagttaccaggactagagttagtgggtgatagtcagatgaattagacatattgcataatttaaagagctggtattctaatggatgaaagccttcacagaggacatggtatctgagctgaacctcaaaggatacatgagaattcactagacagagaagtgagtgattacagaaggagagaaaaacatgaataaaaccagagtggtaagaaacaaaccacttctgggggaatgaaaaattctgagtggttacaataaacagaagatgcttattaaaagtacaggttcataaagaactcaaataactcaattgaaagaaaatacataatttaaaaatgggcaaaggatctgacatatttctcaaaagaagtcatacaaatggctaacaggtatatgaatgaataaagaaaatgtggtatatatacacaatggaatactattcagccttaaaaaataaggaaatcctgtcatttgtgacatgaatgaacctggagaacataggttaagtgaaatatgcctggcacagaataacaaatactgcatagtttctctgatatttggaatcttaaaatgttgattgttgaactcatagaagtagagagttagaatggtgattaccagaagctggaggtatagagagggcgttagggagatgttggtcaaaaaatacaaaacttcagttagatagaaagcgtaaattcaagagataaattatacaatgtggtgactacagttttcctttctaaaaagtgcaggcttttaggtctcacctaagagattctgatttagttgttaatggggaagagaggttcaaggaatttgcgttttgaacagaaggcccaaataattctgatataaacaaaagtttgacaactgtaatatatacagcttaacgttttccaaaagatgctaatggtctttcattaatttaaaaaaaaaggtaccagtgtcaaataaggaaccaccacatactattcttttcttggaaattcataatgcacattggcatattaaaagtcctgtggtaaagaaatcaatttcactcagcatttcccaaacttatttttccttgggggaagaaatctttacgatctctcaaaatacaagtatgcaatggaggctagatggggtagagctgaaacagaggattctgaccaggtaagcacgttccctaagcatactgaatgactaagaaaatgtctagaaaaataaagcaaagtcggttaccctgggggatatagaggcatccatagaggcatccattaatttcttccaagcaaagcccaaaaccacctatgatgtcctgttttccagccagacagccagaaacttcctctctctcaagtaacacaccatggctttgtactatgacttctggtcagtactctctgtggtagccacagttgcagagagaacaggagtatgcagaattcaaagcatacaggtgaagacacagggggaaggacaaagaggaggtatccttgcctacatttatttatctttattgctattacatgttcagcatagagcactggcagttgctagtaaggcttctggaaaagaaaaaatccttccagctccaaaagtagcctatgacagtcaatgaaaagtgcaaaagacatgaacctaagaaatttccaccactctgaggtgcttaatattatgcccaggggagtttttgaaacctgccttcttcctcctatgctgtgaactgggggatttgccctgacatacaacctacctccttcctgttaagaaggggtaggagagagagaagtatgagggaactggacaagccaaagcaacaccaagatcctgacaaactggtttgtgtgccgaatatttcaagatgtacatactgcgtcaatcaatgtatacattttttttctggtataaacttaattacttccatacacgcccttctcaactttccaggtgctatgtggggacacatcctaccccaatctagaggtgatttcaacagtgtgtttcaaatacgttttttgtactccaaccatctcagggcttttaaatcatactttctaatagcacaagtatttattccatcattccacaaatatttcctgagtgtctacaaggtggcagggcattatgttaggcactggagctacaacagtggacataggagattgcggattcctattcagcctacggcataaaacactaaattctaaattcagtctgaaagtgcatggaaaaatctaatgaccagcatcatgaagaaatgtaagaggcagagaagactgactggtccttccttttgaagtgttttagcctgtagcacaaagcaaacaaactaatttgcatttcaagtgtcccagtgtatccagaagatacgcaagggttaaagtaaacagcacagcctggaattaacaacctatgattagaagagggaggagaatttcaggatctctttctcctcagaatttgaacccccagtttgtttgatccccaaacaaatctatgaattctcacactggaatttcttaatcctcagatataaataccagtaactgcatcagagtccatgtaactttagtcagttaaccaaaaaataataatcttatcaagataagtgagtgagtctgacatctagtcctaagaaagccaacacaatcacacctaatatttcaccaagtcagtgttccccagcatgtggtatgtgtaccactggagtccacaaaataaatgtaagtggtccataaagttttttttttcatttcaatgaggctcttatatatcactcactacaggtatgtgagtgatgggattaatgcatgggtgctacctagcattcaaaggcagtctgcaaattttcatagtgaagattgtgcaggtgacaaaaaaactgagagctggtaatgaacttacccacgcatgttggaaatatttcctcgttgttgatctgaacctcaatccaatccataagaaggttcatgtactggggagctggcagcgctgttggcttcttatacttgagatcatcctgccaccgatactcatatttggggccccctgacatcacaggacaggtccgctcggtgcagaactcacagatggtgccatagatgaggttgatccgattgaagaagtccaccacatgtactgccacccagtcattctggtcctccccactgggcaactgcacagccgccttcaggtccacacccgagttgagggatgcctgagcccgtttgtgcagctcaaacctctgtgtgccaggttcaaatttcctcttgggtcggaaggtcttgtccttgttgaatacctgcttcagggctatggacatggtcttctctttcgcttcctttcttttgcaggaagcgaaaaggcacctggaacttttcagggagagatcacagcccaacagtgttttccactgccagcactcaggccccagtcttacagcctgtagcttttaagctcttctaaacagccccttccatcttcctcttgaatgatttccaagggaacctcatgttctttcctaaaggtagaagagaaaagggaacacatgagtgcccagttcgcctttaaaaaatgacagtcttcaacctgatttccaccttgtgttcttggctgtgcccactctccatccaggtatatgggcatgggggttaagccactgccctgtgactctgtactgttgatgcaaaccatgcaaataactaaagaagaaaaggcatcacacttgttttgttcatggcctttgtcaaatctctactggctcttctttgtgtgatcataggcttagtggacctttccaaggtgttaaggatgaacatgttgatcaatggcctgatcctatcccacgtgtgctagcttttagagccccaccccccaacaactcctattaagtaggcatggggacacttcccccatccttctagatacagatgatggaaaaggggtggctatcacaccaagctggctaataagaatgtctctcctgggaatttggaatcaggactcagccttggttgggcattagtgatgtggcattgggtgagaagtgatgaaaactgggtctggttgaatcttgcttggaccgtgtgtagtgcagttgagaaagctggtctgcagagccacggaggaagaggaggaaaaggagaaggtggagaaggtggctgccaatacacagagaaacagagacaagagcctaagtggccacagagagaggaagacaagagaaaaagagagacagtgagaagaactaatcctgataatcttctagaaactggttccaattccttttgaagcctagctatgcttcatgccttttgggatccattcacatttcctgaattagtcaaagccttactgtatttcagctaacttgagttggttctgtttcttgccaaacattcctaactatgacagtatttgtcaccttccaatgtgccgtcctttatacccttcatctcacactttagacagcactttgaggcagaactgtccaatagaactttctgtttccgtgataatgcaaatgtgttatatctatggtgttgaatatggtacacactagccacatgtggctattgagcatttgaaatgtggctaatgtgactgaggaacagaattctacattttatttaattttaatgaatttaaacttaaataggtgctcacagctaccacactggatggcacagctctgaagtcttcgatgccctcttctccactaacttgttgatcctcacgaaaatctgctgaggtttatagatttataataggtctaatagatttatagtgggtatcattcttcctgggtctccaagagatacaattacttgcctaacaagatcccatagctagctggagcatgctgttagattgaaatccagtttgttgactcctagcaaatgctttctctacatggccatatattcccaaaagtaatggacttcgacttgtctttcctactggtttacaaagcttgttttccccaaagcttctatccacatattccccaaagactgctgtatagattggtcggaggtgaaggctatgttccgtggccttgaaatagagaggagataactgatccactcataggtcaagccccaacaaaatgagccaacagctgtggccagattcagaagagcccaacacggaatctgttaaaatgggcttggagcatgatcccactaactgttttttccctgcctgtaaggggttctgccattccacactcaaacagggcttgatggtactttcaaccttaagttattgaggccaatatacctaagacatcctgattcccccttatcaactctgctcttcgctcagaattgctaaccaggcggtggaatccccgccccacccccagtcccaaggcctctggctctctgcctgctcacttcctccctcttaaccccaccctcttcctaacaggttttcactgaaatgccatatccgcaaggtgggttttttttttcctattcacaggacattgacctttgacccactccccaccaaagagatccatgtggaaaagcaggtcacatgaaactttctgcctgagacagtctgtgaaatcacacttctgggtaccctggaatagcacctgtaaggatatcaacacagaaactctgcaaagtctagggaaagaatggagtgatctcttttcctaaagaataccttcctaaaagagacttagcttgcctgaaaacaggcttaagaaacctgagggttttagaaggaaatttccaaaataaaagaatgagctgaaggttggaaatacagagaaagggtggtgaggacttgttttttaaaaaaacagacaatagtccttctatgtctcaaatgcttaattgctgacagtaaaacagtaaccaccaaacagctgccccctcatgtcttgaacaaatgagacttgctcttctattaatctgataatgagggtaccatcaatgcccacagtcctcagagcaactttctttcatggccatacatacccttggtgccactaatccttctgttttccctcagccaggagtgtctgcttgcatggacaccattgtggaaaccttcctccgcacctgtgccaggctcttgtggatgccatcaacaaacccctctgacacctctgacgggagcatgtgaataacaccgaataatcacaacaaatcctcctcatcataaagccttgcgtggactggcactcgcaaatatttaaataaatattaaaacactgttggaaatttgggaatttttcttctagagatactcatataacaaatttgaagatatgttttttttttttttttgagacaggaagatcacctgaacctgggaggtcgaggctgcagtgagccatgatcatgccactgctggagtggtgtggtgtgatcatggctcactgcagcctcgacctcccaggttcaaacgatcctcctgtctcagccttctaagtaccagggaccgtaggtgcatgccacaatgcctggctaagtattttatcttgtattttgtagagacatggtctcactttgttgcctaggctggtcttgaactcctgacctcaagcaatcctcccgctctggcctgataccagtctcttgaactggaaggacaggtggtattatctccattttacagacaaggaaacagagactcagatctcctagtgcttgattcaaatttgtaaatgattctgacatggtcagacatgaggctgtctctttaggtcaaacttttgaatctaaaatgaagctttcttaagaagaaataggttgatcaggtaggcccccccccatgtttaaagacaatggcaatccaggatggataataacagatgtatcatgccactgaacgacagaacaaagaggcacccatctgtgtcttttcctgagtgtgagatgccatattggcgcaggtacctgagagttttgaaattaaaaagggaactgtaaatgcacctggacttactttcccagcccagagcccccttgggacccctgcccataatttatgctgtgggctaatcaaatagttagaacagtgcttagccaatgtgaactcagggatcttgttaaaatgcaggttctgattaggctggtctaacagtctcccaggtggtactgaatctactggtccatggatgacactcaaagcatcaaggcctgatctaactaagtgatcttgttagaaatgtagactctcaggcttcaccccaaacctggtagatctaagtgtgcattttaacaaaatctcaaaagtatatgatctgagaagtgctgggttggagggctgcctgcctggctgagtaaaggaatgaataaacaaacttccatttattgttttgtcaacagattgtttcataaacagtcttcagttgagtgtgggtatgttcgagaaaaaaaaatgagagatactgttttgaatacaatcgccttgacagatggtgacaatgaccaggtcttttgatctggactgacttgtatagcccagcacccagcacctaggaggtctccagtgaataccttttcataaatgccaggtagagggcagctgctgctattgcggcctcaagcagaaaggtttctttggctgaataaactgtagcactagcaacaacacagtggttattttctgtcctgtttcagtctccaaaaaaaaaaaaaaaaaaaaaagtcataaagttttccttctaagtagaaatggaaagtaaattctatgtcatgaactgcacccatgacaattctggttgttaataaatatttgaaaccaatggttcatttgatcaataaacatttactaaaagctttttatgtgtcagacacagggctaggcactaaggacatagagttcataaaaatgtggtccctgtctatgaagaattcacaatttggtatgtagttttgaggttagttattgacttttgcttttaatactataaagttcaatgcaccaacatgcatactgatgtgactccttcagagtattacttaggtcagggatgaaacaggacaataaagggtgaggtctttggaaagagaaaaacagaaatctaaataaatagcacaaaactgacagaagttccatgtgctctccatattttctgcctaatagatcaattataacaataaaacatgtgcactataaaaacatgcagagagaattcggctgggctgcaagggaatgttgacaaggtagctaagcaacgcactggcaaggaaagttctaatttttcttttcctattgatgtcttttgcctcattagttgagaaatcaaagagtccttgccagggataaggaagaaataaaacaactctcccagtcactcctgagagatccatcttctctagccaggcccacctctaagagaccttggtggtactgaagggtgagggggttaggaaaggagagggactgaagctgataccagttgcaggaaaggcagttcaatatcttatctgtgaggtggaggactcctcctggcaggatcagctgccaggatgattcatttcctataggaaggccataagagaaatgccccagaaacaccccgcatgaaggaggtttagtgtcatcttcattgccaggcacagagctgacttaactgaatgtttgctgaatgaatgagtaaatgacagtgaattacgaacattttacatcacagtgaaaccacaaaagaggaaccaaagtggatctcctgtcttcagttatttggggactctatgtcaatctgtaagctcactgccaactcactgaggccgctgggataccctgaagtaacaagtctgcctcctgaaaggacaagacttcagctcaacttttctttcaaatgagctgctccattcctctgtgttatctgaaattccacctcttcagaatcaaagaatgaccagtctgatttctcattttcccactatattgttctctttatagctggaatagtccttggaatcgtcctcccacttcccaaatattgaattaaagtagattgggtttttattttagaggggtgtatgtatgtgtgtatcataaaatgaacatcgtctgacctttccaggatccaataaaggatgtgcctaagatgcaattccatcagcccttatgcactgtttaccttatgcctacttagtaggtgccatctttgcccacaggacaaccccagaatggaagagattcctgcctgagaagcagctttgctatttttttccccaacgaattcaactcctcaactttgagctgtcatatcactgcattttgttacattagttgggagaaaccttgctgcctcattttaatcttcaaagatatgcatggtttcagagcttagaatgctcacattatttctgaacacagatgaagttagtacaaataggtgtaaccgtacagaagtctgtcacaggactattctgctcatcttctagctcttcaatggtcgtttgaattgcattcttgctgtttcacaggcttattgttttggtcatcagtgcagacattctagcatcaaatgtgtaagtaaatagtgccaaaatgaaagcattacctgtaaccttatacactgtagcagcagcaacagctacaatagatgaatgcacaggtgttttcagcaaaaacctataatgattcatcatcattcagaagaggacacttagtggtgagaaagaatggaaagagtaaaagaaaagagtgggatttgtttggtatggtttgaaacattacctactgacagtccatggaacaaaagacagagttttaaaaaatgttttctgaaataaagagaataatgttccttctggacaccagtaccaactagcttagattcccaacaatgacaaagatgaagaccttttggtcaaaccttgggcagggttgatccaatcttactgcagttgtaaaaataaatagtaaagtaaaattattacaggataaaagctcagatgacctatttaatcttataaagattataaatcttataatgacatcctactgattatactgattttttttaaaagaaagagaaacttctctaagtcagtgagagatttggtatattatttccagatatttagactagctggaaaatattcatttttgtggcttaaagaaagacacgtgaattgaaaaaaacaatatctaagtcaggtgagggtagaagaatgggggatgggatgagaactacagataaagcttaagttatagctgaaataaaaaattaaggcaggtaaaaaatgtaagtatttttactttttaaagcatgagtgtatatcagctgatatgatgtcactctgaaccttgaacggatattgagataagtatttttactttataaagcatgggtgtatatcagctgatatgatatcactctgaaccttcagtggatactgggataaaggtcattgtcagttaccctttctttttctttgaaacagcgtatgtcaatcctttcttggaaaagtcttaaaggaaaaaggttcaaattcaaggaagttggatcctgtaactgacaacagacttgtttactcttagccactaagtgaacttgagtctcaaagtctgaaaaatttctagccctagcaccatgagaacttatgtatgacatctggaaccattgcaaaagatctttgcaggaaggtggagaacacaaaatgggcaagaagactggaaattcgaaaatacagtttgaattttcaaaagatcataagtttaagtttgacaggggataggtaaaattaacaccaagagcaggcaagattaagaggcactaaagcccagtggctaacagcacacagcttttgcagggttgctgcaagaattcaaacagtttacgtaaaacacttagcattagcaagtactgaatatagtatagtggttgttgctatcatcatgttcatcatttgaatcatattatgatacaagttttactagagagtcagattcttgagagaccagtcacctagaatctatcttaggatgcctaaaattctaattatataatattaacaatggtatttattaaggacttcctatttattttagttttcacaaccttatgaataggtattattattattatacctaatttacgcttaaggaaactgagacacagtgagattgaagctatatcctgatcacagaaccagtaagtagccaagctgactccaaacctcttaccacctacttaaaagtgcctctttagacagttgggtagttaaagaaaaaaaacaaaacagaggaagttctggggtacacctaagggggtcagggaggaaatgggagaaacagagacctagccctatgtacattgtcatgtgccactccagaagagatctatttctggaaacttcgcggtctagattcaaaagacctggattcaaattctggcaatgactttagctggctatgtctttgaacagacactttttatgaatctcagttttgtcttctttaaagatgatggtggctgggcacagtgactcacgtctgtaatcctaacactttgggaagctgagccaggctgattgcttgagcccaggagttcgagaccagcctaggcaacatggcaaaacctcatctctacaaaaaatacaaaaattagcccagtgggacacgcctgtagtcccagctacttgggaggctgaggtgggaggatcacctgagcctggggatgtccagactgcagtgagccatgattgcaccaccgtgctccagcctgggcagcagcatgagaccctgtctcaaaaaaaagaaaaaagaaaaaaataataaggataacggttaatggtgcttacctttattgtaaggttactgtgaaaattagaagagatattgccagtgaaagtgcttcacaaatggaaaacaattatatggttattgacatagtgactgataaaagaaactatgacttttgacttaatatcaagaaatgatgtgagaaacagaaaatgattcagttcaatgcaaatgtgtgtttacgaataagaaataggcaggaggtggtaggggtggggggcacggtggcaatggaagccctgcataggaggaaagaaagaaagaaaatgcttcattcttgcttaatttgggtggacttctaattctcaggcaaaaagaaataatattaacctcagtgatttgataatgagttaacaatattccccaacatttataacacacttaccctaatattttgagggagttccagtatttttttgcatataataaatctaatgcaatatggcttatttcatgaatttgggcaaattatatccaccatgccctcccactaatccctcaaacacttttcagaatagcatataaatactctacatttaacacattacattcctggttataatccagttacaacctctgtattctgataacagaaatgactttctaaactgtttaaaaagttattttttatattagctcattttcatgctgctgataaagacatacctgaaaatgggaacaaaaagaggtttaattggacttacagttccacatggctggggaggcctcagaatcatggcgggaggtggaagacacttcttacatggcagcagcaagagaaaaatgaggaagaagcaaaaaaagagacccctgataaacccatcagatctcgtgagacttattcactatcacgagaatagcatgggaaagactggcccccatgattcaattatctccccctgggtccctgccatagcatgtgagaactctgggagatataattcaagttgagatttgggtggggacacagccaaaccatatcattctgcccctggcccctccaaatctcacgacctcacatttcaaaaccaatcatgccttcccaacagtcacccaaagtcttaactcatttcagcattaacccaaaagtccatagtccaaagtctcatctgagacaaggcaagtcccttccacctataagcctgcaaagtcaacagcaagctagttaattcctagacacaatgtgcgtacaggtattgggtaaatacagctgttccaaatgggagaaattggccaaaacaaaggggttacagggcccatgcaagtccgaaatccagcagggcagtcaaattttaaagctccaaaatgatctcctttgactccaggtctgacatccaggtcatgctgctgcaagaagtgggttcccattattttgggaagctccacccctgtggctttgcagggtacagcctccctgctggctgctttcatgggctggcattaagtgtgtgtggcttttccaggtgcacagtgcaagctgtcagtggatctaccattctggggtctggaagacgatggccctcttcttacagctccaccaagcagtgccccagtagggactctgtgtgggggctccaaccccacatttcccttctgcactgccctagcggaggttctccatgagggtcccgcccctgcagcaaacttttgcctgggtatccaggcatgtccacacatcttctgaaatctagggggaggtttccaaacctcaattcttgacttctgtgcacccacaggctcaacaccacgtggaaactgccaaggcctggggcttccaccctctgaagccacaccctgagctctacgttggccctttcggccacagctggaatggctgggacacagggcaccaagttcctaggctgcatacagcacggggatcctgggaccggcccacaaaaccactttttcctgctgggcctctgggcctgtgatgggtggggcagccatgaagatctctgacatggcctggagacattttccccatggtcttagggattaacattaggctccttgctccttatgcagccgacttgaatttctcctcaaaaaatgggtttttcttttctactgcatcgtcaggctgcaaattttctgaacttttacgctctgtttctcttttaaaacagaatgcatttaacagcacccaagttaccttctgaaagctttgctgcttagaaatttcttccgccagttaccctaaatcatctctctcaagttcaaagttccacaaatctctagggccaccagtctctttgctaaaatataacaagagtcacctttgctccagttcccaacaagttcctcatctccatctgagaccacttcagcctggaccttattgttcacatcactatcagcatttttgtcaaagccattcaacaagtctttaggaggttccaaactttcccacattttcctgtcttctgaacccttcacattgttccaacctctgcctgttacccagttccaaagtcacttccacattttcgggtatcttttcagcaacgcctcactctactggtaccaatttactatatttgtccattttcatgctgctgataaaaacatacccaaaactgggaagaaaaaaggggtttaattggacttagagttccacatggttggggaggcctcagaatcatagtgggaggcagaaggcacttcttatacggcagcagcaagagaaaatgaggaagaagcaaaagcagaaacccctgataaacccatcagatctcgtgagacttattcactatcacaagaatagcacgggaaagaccggcccttatgattcaattatctccccttgggtccgtcctacaatatgtgggaattttgggagataaaattcaagttgagatttgggtggggacacagccaaaccatatcattcctgttatcattcctgttatcagaatccagagatcctgccagaaggattaagtctgcatttctagaaactctcaagagagaacagacaaccatctagctagatgatttctcatttttctacatgaaaaacaggtacacaaagcaggtaaccctgagataaaattgagacaaataattaatgattctacccactctattctctcaaacatgccaataacaagttaaaaaaaaagtttgaaatgaaattgagtcagacatgtaattgcaaaccatgtatcctcctcaaagactgaaaagaggtctacctttagagccagaaagatgcaggtctgagtccagactctgccccttgaccagttacccttgtgggctaaatgctttctctttgtgctttaatttctttctttgttgttagggtgctaataccaatatcacagtgggttttggggataagtgagataatataagtaaagataggtaaatgtcaagtgttaaatttattaatctggatttctcctatgatcagatttcaggtggtgtgatgatcaataggagtcccaaccataatgtgctctttctttgacttcttccccacaagacctaagcacatgaccctcaaaaagtgtaaaatcttgaggcacctcagagggaagcaccatttccccactcgtggtttggatgaggaagaattttccctatgcatcctactatcctctctatgtccttttactaacatcgccccagggcaagtggagggatggattcacttagttggcaaaccgcacatgctcagctggctcagcctgaccttttttcctcctgcgaagtgcctgctttcaagtgtgctacctgctgcttccccagctttctgcctttatgaatggaattggtctgctctcaccagtgctacatgggaaagggtgggcaaatccagagtttagagttaacaggcccattggttaacagtctggcttccataagaaacaaagttgatttttgtttttgttgttgtattgttactatcaacttctttgaagccacatagggaagagtggtgtgacttgtttattagggctctattggagaactaacattgttaagttgtgcagagtggcttggctatgcaaagttagctgtttttgttagcagagactcttcgtgacattagttcaacaagaactctgtttaagacataacttactcatctgcagaaagtctgtctacacaccagaaatgcatagccttctcaagagatttctcagctaagaaagaaaacctagtcatagggtgcatttgtaccagttactgctcagtggcagacacacagagacagactgctcagaacagagtcccccatcatctatgaagtgcttctgaatcctccacaattgacagtgagctttaggcctgacagtcccatgcccctgtatgtggctactgtctgggaacatgattatcagaagctttctccagggaactgaaaaactttctatccactcagataaggcctctcccttgcccagcctcgatttcctcaaacttctctctggcttaacttcaactcctggtaaagcagagggaacaaggtaccaaaagaaggagcaagaaggacgggatggctggtcatcgtgtgcaccttgcatgcacatctctgatgcgaatgccccaggaccacatactgtgctgtatttctttgctcacatgtctggcccctccatcagtttatgagggttgggagcacaccctagacttcactgcatccctggtacctaacacaggacccagcagaaacaggaactcagtaactttttgtggttaaactgtgtatctaaatgattgttaatcaaataccgcacagataaacagttctttctccagttgagaggactaggcccccataatcataatgagacaatggacaaaaggaatcttttcagaaaacagaactacttcatgcaaagatcaacagtggctactggacatgatgtttcccaggccaatctaaacagctcccatgttttcattttctagcattcagtgaaaagtcagctcctttggaagcatgcccactggcttaaaacaatgtttaaaaagtcatggtagaactttgtaaagatctttgcaataccacgcaaagacctttacctttgtgctttgtttaaaaaataagttttaaaaatatacctcagaggaaaaaataatggggaagagagcaagctaatcaacttgggaatttttctttttttgtagagatgggggtcttgccatgttgcccaggctggtcttgaaatcctgggctcaagcagtcctcctgcctcagcctccctagatgctgggattacagggatgagtcacagtgcctggctgggaattttttttctaatacgagaaaaaaaatgtatcatctcacctcctttagtgaaaactcaacttctgtgactttggtgtccatgcccaagcttctgtctctgttgcatccactcttgttgcctttgtacccttcagtgacagcatcctggcccctaacctgtctccctcaatcatcccacacaacaccacgacattaattttcctcgaactttgatcctgctacccattccgtgtgcatctgctagggaggcctgatagcaaggtcatggctgacaggattgtacagcaggaagaacttctgaacatcagttaattcaatagagcctcttaatttattaaaaacaaaaacaaacagctagtgcccagaaaactgaagtgaatatttaaaggttcacagttaggacagacctggggctgaaaacaaagcctcaacctcagtgcctgtgttctttccactaggcaatggatctgtttaatacttcagcaagtctgacacttaatggcccttcaaaacttcccccctcccttttcgtgccaggcgtggtagctgacacctagaatttcagcactttgggaagccaaggcaggaggatcgcttgaagccaggaattagagaccagcctgggcaacaaagcaacaccttccccctcccccagccatctctgcaaaacaaaacaaaacaaaattagcctggcacggtggcacacacctatggtcccagctatctgggaggctgaggcaggaggaggatcacatgagcctaggagttcgaggccacaatgaactataatcatgtcactgcattccagcatgggcacagagtgagaccctgtctcttaaaagaaaaaaaaaaaaaagaaaagaaaactaccccaacttaactgtctttttagatctatggagagatgtagatatagatattattcatattcctggtgatttttaagccttttaaagcaacatagctcctttgttcctccaaatgaagttttatgcaggccctcaattttataaaaataaataaaaattatttatctcttctgcagctgaagcagggtgtctactcctctcaacagccactgaaacacctctgagaactttcaggtttcgcttgatcaatcggacaactccccagacccctaatgctgactgcacttgtcagtggctaaatccctgcccctgccctttcttttgccttccgcctgccataatcctccagcctccaggcgacttctccctacagtgctgttaggaagtgactcttgtctctcctttgctccaaagctctgaatctgtagcccttcctttgtatctaaacagtccgatttgttggttattctcacagctcacccccaacttctggcccatctataatcagggcccacccacccatctgttagccctgtgggcccatcaaagcaggcttcaaacacaagctgccacctctggtggaggttcagcctaccccttccccttctctcctgacccttccctaatctggctttgtttctgccatccctgccgcactcatttggaacccttgcttttctcagcaaatatttatgggtttgacttgttcttattgagttctatactcttcccccagcactgcctccccctggccttttatcttttgtttgtttgtttttttctctttcacttttccccttttgagctctggcggctctggtagaaggtggtggctgctgaaggaaaaaatacaaccccttctcaccctgaaccatctgtccacggactaactagtaagttccctctgggtttcctggggacactcggaaatggcagaaagaccaagatcacttgcacctggggtgcaagtttaaaatgcagactctagcatcccacccctcaccagtggatgtgtggactctgctgctctccaggatttaagagctccctgagccagggagtctgacatgcctggcctggcatatccagtggtccatgggccaaaagtcatttcctgaggcgaataggcaggagacaaaagtggtcatctgaagagttgtatttccagcagtaagaatggcagaaaaagtccttgggggaaaggagaattaacctgaatcattattgggaatatacaacatggccctgcccctactggtctacaccacctgtggagaggctagttcaatgaaccacccctgcgctttgtggctcttggtcactgtgttgtatagactggtcgttaagtaaatggatctgagatcagactgcccgattttgactcccaaatctaccatttctagagtgtgggctctggagcttactatatcacattgctcaacgttagcttcctcttcttccatttctgtaaaatggagataaaatatccatctcaaagggctgccatgagagttaaattacattatccaaataaagcatttgatatagcagcaagcgcaaggtaagtttgtaatatgcattagctttaattcttatcactaacatcatgctttcttgaacttactcatatacatatgtctccctccttctggatagggaactcctgaaaagcagatcccacaggctgctacgttccctctctcctaaaacactcttagtgggttataccttgcaggattgtggtgatcaactaagacagtaggtgaagagaggttagcagcgggtctggcacactgtaggccagaaagaatcatcccgagtccaagggtgctttttaaataccaaatatcttaatcctgatgtttttatgtaaccacaatgtgtagacttgtcaaaaatgttaaaaatagaagaaaccaaaaatcaaagagaaaaatcttctcatagtttctaatccaacttgcatggaaatagttatcttgcaaaagagtgaagggtgtaaattttttcattcatttaggggagttgttttggtttttcttgttttattctttgggtagtttatttgtttttcccacactattttttttttaatgacaagtaagggtgacaccacttttcttaaaaacaataaaagctacagaaaaaaaaaaggctttaaaagtctccaaaggcctcaggaacttttgcccagagaagtgtactcctcaagcaaagccatggaaaacaacatctgccacaggcgcagggctgagccaaacccctgcggcgagggctcgctttatttttggtccaagctgacagtacaggaagccacatccactgacttctttttcatttaagattctacattcatcaatacgtcttgttaggtaagcctccagtggatttcctctatttggtctaagaaatctgaagaggaaaaacagaaacacacagtcaccattcctaggaaaatagtatcagcccagcaagagaccaaaacaggtatctggtaaaagctcccactctattctctttaaactgcactttattctaaaaaaaaaaaaaaaaaaaaaaaaaaagagctccctgagtttaaacagtgtttgattttatataagcaccagatgattctaattccttttggaaaaaggtggtggaggattccataaaaactctgataatcatttcttctaccaactttagtcaacaaaaaaattgaaaggcttaacgtaggtgaaaactgaaaaatacagagttccgcaaacacaagttaagactgtcatttttaaaaagaagcatctaaaagtcactttggtgcatctcaaatgcacgtctttacataactgatcaagatacaaaccatttgcaaacatttatgttttaaatcacagatagctattccaactcagagattttaagtgattacacaatgaactggtcctcatttgctctcccttaattttccctaaccttgcatggcttctagaaaaagacaaaaactgacagacaagggtagtatggccaaggagccctgatttatttcagctttgaaaggccactacacttggattctcatttctgcaaggaatgcaatccagagagctgagctcgctgtcctgaataaagtacacgtttttctcatctagcggagtaatcttgtgaaatgtgagtacaatctgcccagtgtctgagggaggcaaagggggagggtggggtcgtgctgggacacagaggagtcactccctgtttggagagccacgctcctagagcaccaggctcacaggagggcacaggcaggaggcaggatcctggccttcacggtgcccaggaaagagaagctgtccaagctggacaagcagagagggacctgttgccctgagagctagtcgctaaactaatccacatcaaggagggccatgggcctctggggcaacacagggacctgacaatagaaagcaaggggcagtgtgggaaggaatctagcaccttctccaaccaagaggtcagccccaaacaggggatgttggtgatggaccccatcaagacattccctcagcttcatcagaggtcatgcactctccccagttccacacacaccccaccttgctcacaagcagaaggggaaagaaggcaccttggcattcatttgggaagctgccaagacagtctaatctttcaaatggggcatctaacctgatagcagccacagtgcaatagactacatgtgttcaaattctaacctccaatgtgatggcattaaaaggtgggacctttggaagatagtttggttatgagggctctaccctaatgaatgagattagccattataaaagggaccccagaaagctttctaccctcaagagggcccacaccagaacccaatcatgctggtaccctgatattggatttccagcttccagaactatgagaaatagattttctgttgtttataagccacccagtctaaggtatcttgttacaggtagcctgtaagacacacagatatttacacgatctcatttttattatagtctaggtttacaatgcatttaattttataaagccttgtatgggaaggagataaagtaatagtgataataatttatatttcctccaaccatatctagtaaacacaaatgggtccttttaagtaaagtttctttctgactaataaggaaataaatgtatacctcattactgtatgacctcccagaagctcatgagttctgaggatttagaagaaattattcaagtggaacttccctagacatcatgggcccaaactgactccttataccagagattactttttaattcctctcatcaaggctggctgaataaaccttacccatgtcagcacacaagtgaaggcaatgacattttttaatggcataatccaggtcatcataccctagaatagtcaccatgatgcatgtgcctgctgattagaaccttcgtatcattcctgttgcaagacacatagctacttcctgttctggaagttttggaggggtgagaaaaagaagggcaagaagggaagagacattcatgacaaaatctggaaaggctctttgaggagctatagcctctccttctcaggcagtagcaaatagtctcatcaaaacaaactttgaaatctagaatgaagattttgaaaagaaatccactgttatatatgaaatgttaaaacatgcgtactttttccctcagcaaacccacctttaacaatctatcaaaacacaaatgtattgggttatggtgccaggcagatttctaaggtggctcctagtgatctctgtctcctggcatccatgcttttgtataatgctctgattgagtgaaggctggacccagagactgacttctagtgaacagaatacagcaaaagggatggggcactcttctgagattagcttataaaacactgtgacctctcttgctcacacactcttgctctcgctttgatgatgccagctgccatgttgtgagctctcctcctgagaggcccacatagcaaggaactgaaggtgccttccagctaaaagccagccagtgaggagcaaaggccctcaggccaacagttcaccaggatctgaatcctgccaatgaccactgagtaagctccgaggcggctccttcccagtcaaaccttgatacagctgcagcctcagccttgggagagatcctgaaccggagaacccagctacgctgtactctgcctgctgacccaaaaaaactgcgagataataaacgttgttgtttttaaaccactgcattggaggggattctgttatgaagcaatagataaatcatacagctgtttaagcctcattgtttataatcacatacaaaaggaaacaaccaaaagtccattcattgataactagtataatcaagaatggcatatccacataagaaatattgggcagccctcaaaacacagggaggtcaatatatctgtattgatatgaaaagaagttcatgaaaatcaaaaagcaaattgcaaaacaacatgtgacttttaaaaaatggcagatatcgacatccattcctgtaaactccagataagctcctcacccagtgttctcatttcagaaaacaattctagtagtctagttgctctgtctaatcaatttgaaagtatatcatttacttcaaattgccaacacatcccaaactcctcacaccctccaccacaactactcttgtccacaccaccagattctctctctttacagctgccattgactgggctggttgcactgcctccacttctgctcctcggcaaactattatttccagacaggagccagagtggtactttaaagatataagtgaaatcaggccactgccctcttcaagccctacaatggcttcccatcacactcagaataaaaacaaatgttgctatattggtttacaaagtcatgatctacagatctggcccctggatacctctccttcccctacgattctctcccttacttatctgctctatccacagtggcctccctgatgtttctacaacatgccaagtcttctatcacttcaaggctgtattagtttgctaggcctgccataacaaagtactcaaaactaggtggcttaaagaatagaaatgtactgtctcagttttggagacaagaaatctgaaatcaaggtgttggctgggcaatgctttctctgaaggcactagggagaaatctgtttcatgtttccgtctttgtttctggtggggttttttggtatcttcagtgttccttggcttgtagactcagcacctcaatctctaccttcatcttcacaagttatccttcctgtgtgtatgtctatctccaaattttccctttttatgaggatagcagtcattttagattagaggcccacccgactccagtatgacctcatgttaactgattattttctgcaataaccctgttttcaaataaggtcatgttaaaaggtattgcaggttaggaattctacatatgaatttgggatggggaacataattcaaccccaaaacaactgcctttgcaatcactgtcccctcttcctgaaaagctctttacccagtgtggctgccatgagactatgccttgtagacatccaacttacaaggagtattactggctaggagttacagctgctgtgctctgaaatccatctctgcatttgtgctgaagccacatttctcacaggctactcctagatagtgactgagcatggcaggcatagtgatgcaaacctattcctgggagatgaaaacttacctaagaggtggcttggactcaaagactcctccaagagatccaggctctcttgaaacagcacagccctgtaggatgcttccgctcaccctcctccctcccgtcttcttcacctggggtcagacctgcatcacaatcagaggagtctcccgagctcccagcagctcactcctactttccctcatagtcagacagggcattcaaaagggctctgtgcttggttgaatactcctctgcagccatcttggaattcttaatgttattttgaacaaggagccccacattttcattgtttccttgacctcactcttgctcacaggagttgccttaataaatctcttgcatagccaatcctgccttggcgtaatgcttcttggagaaaacggactcacaccccagataccagcatgattcttcattactgcatgtaagcctgtgctcaaaggtcactcctcagagaggtttcctttgccaccctaataaagcacatgacccaaaccagtccctctctctcccattctcctgctttaattttcttcatcgctccagctgattttactatatgttttacttattgtttgttttgtctttcccatgagaatgtaaactatacaggagcaaagacacagtgttatttattgttgtgccccagcacctatgacaaagtcaggaacatgataggtggccaataaatggtttgtgagtgaattaatttacattaaaaatgtcagtctgaatttacccagatcctctttcagttccaaaatataagccatggcagccatcacaagaatgtacctcatatacctgtaagacataactgttcttcttaatgcaggccagaaatgaagccagaatccaaagctaaaccaataagaatgagagcaaatactgctatcacccagaggggtgttgaatctggatacagctgcttaggggtttagggctgggatgcccatttgagaacaggtgacatggcccaaggctcatgcaaggtaagatgctggaactgacataactgcatcaagtcagaattcttcaaaatatccatttacataaaaacaggactagaagaactaccactgctccaagtagctcagggaagggggaagtaagtctgaattgtgctccagtatcagggtgaaaaaaaatgcatccgattaaaaaaactaaatagaacaccaagcctatgtcatgcacaagtgtgttgcacaaatttacattgtttaggctgtgtaagtatcttgaactaatagatcactataaaaatgttcccagaaccagggaagaagcaaactcaaattgttctgtagaaatattttcataactcaggacctacaagactccctcagaataaacaattcctgctgaataaacccacaaagaatgaagccagtcagaaggagaagccacgtacacaatgagcagaagaattagcacctctaagaacttacagtaagagaataatctgacaggatctataagctaattacgtttaaaagttttttttaacataaaagaaggaataaaaaccataataaaagaaccatcctttatgaacaaagggcaactttgaaaaaaagaactaatttgaattcttaaagatgagaaaaacatgttaaattgcatattagatacagctgaaaagagaattaccatcatgaaagatgggtctaaagaagtgttctgaatggagcagagaaagaaaaaagggatcaaaaaatgtgaaagagaggttataaacacagagagtaaattggggaaataaaacacatttaattgaagttctggagaaggagtaggttatgtgagagtggcaatactgaaatgataaaagctgagaatttaatagcattaaagcaatacatatgttcttgatttagaaaattacaagtcccaagcaggattaaaaagacacacacacacacacacacacacacacacacacacacacacagcggtaaatggcagaacactagcaccaaagagaaagtcatacaagcaaccagagagaaaaagataaattacaaacttaataatggcaattagattggtggtggacttttcatcaataatacagaggccagatgataatgaaatgacattcaaagtggtaataaaaaaacctgtcaaactaatattctatacctaattaagttgctgctcaaaaatgggggtattttaacctgttttacgctgctataacagaataacacagactaatttacacagaacagaaatttatttcctcacaggtctggaggctgggaagtccaagagcaaggcaccagcaactactgtcacatcatggcagaaggcatcatatgggcaagagagagagagggaaggaggctaaactcatcctttataagaaaccccttcctttaataacaaacccactcctactacaatgaacttactcccatgataatggcattaatccattcatgagggcagaaccttcaggacctaatcacctcttaaacttcccacctctcaacactgatgcattgaggattaagtttctagcacatgaattttaggagacatattcaaacagagggtgaaataaaaacatattcataccaaaaaagagagactatccaattcatagacccttgctgaaagaaatattaaagaataataacttcgatatgaaggaaactaagaaaaagataaataagcaatgataagcaaagaagacaaacatgttagtatatttataaacacccctactcaaaaaaaatttttaagattaatagggaaaggcattataaacaacttgaaactaaaacatcagatagcaataatatgaaagagtgattaacttaaagtactctatggcccttgcattacgtgataggggaatagaaattttgaataacttaaaactttttaaaagctaagctcgtgctttgggaggccaaggcaggaggtttgcttcaggccaggagtttaaggccagcctgggcaacatagtgagacctagtctctacaaaaagttttaaaaattagctggatgtggtggtacgtatctatagtcctagctacttgagaagctgaggcaggagaattgctttagcccaggaattcaaggtaacagtgagctatgactgcactactgcacttcagcctgggcaacagagcaagatactgtctctttaaaaaaaaaaaaaaaaggctaagcattcatattattcatataatattttcaggggaaatgaggaaggaaatgggagagaagaaatagaatgcataacttttttttttctttgagacagagtctcactctgttgcccaggctggagtgtggcgcaatctcggctcactgcaactgcaacctctgcctcctgcctcagtctctcaagtaactgggactacaggcacatgccaccatgcccagctatttttttttttttttgagacggagtctcgctctgtcacccaggctggagtgcagtgacgcgatctcggctcactgcaagctccgcctcctgggttcacgccattctcctgcctcagcctccggagtagctgggactacaggcacccgccaccatgctcggctaattttttgcattttttagtagagacggggtttcacaatgttagccaggatggtcttgatctcctgaccttgtgatccgactgcctcagcctcccaaagtgctaggattacagatgtgagccaccgtgcctggccccagctaatttttgtatttttagtagagacagggtttcaccatgttggccaggatggtcttgatctcttgatctgcctgcctgggccttccaaagtgctgggattacaggcgtgagccaccgtgcctaggcagaattgtataacttctaaagtagtagaagaaaggaaagggggaaaaagaatactcaaatgagacatatacagacaaaatatgaaaaaaagaaggaattttaaggatgtaagaatataagaaagaattaagagaacagaaaatgataaatatataagtaaatcaatacaagcactgactctataaaagaataaaagaaacgatgccttgtggagtttgaaaaattatatagacttaaaatactcaaaagactagtgtaagaattgcggggagggataaataagaagggtgttattcaaaggaaggtaaaactattgatcactttagaatttagtaagttaaagacgcatgctataattactaggctaatctctgaaagaataaaacagtatgcctttcagagtggtgcagaagaaaaaacagagtgagacaatgaactcgctcatccataaaaagacaaaaaaggcgagaagaaacatagaaactgtgcaacaaacagcacaaaagactccagcagatatggactaaaatatatcggtacagttaattataacaaatgtaaatcaactaaatgctccagctaaaagatgatggcaaactgaaatgcttactggggcagagtaggtcacataactgagtaaacagccaggtgtaggaaagcaacaacccaaataaccacaactgatgtctcctcagggtcagggagacaatagagtgtggtggcgcctggggtaaactggtaagcgtgtacctgtctaaggaaggtagtttttttttttttgttttttttgtttttttttttttttgagacggagtctagctctgtcgcccaggctggagtgcaggagtacagtggcgtgatctcggctcactgcaagctccgcctcccaggtttatgccactctcctgcctcagcctcccaagtagctgggactacaggcgcccgccaccatgcccagctaattttttgtatttttagtagagatggggtttcactgtgttagccaggatggtctcgatctcctgacctcatgatctgcccgcctcggcctcccaaagtgcaaggattacaggcgtgagccaccgcgcccagcctaaggaaggtagttcttacagatcgttgccatgtgggaatacagtccaatgtcacatatgttaactttcaaaaacctgggaactcggagttttatgggaaatcagaattttaaacatcagccatgaatttttttttaaaaagcaaacactgaaaaaaggaaataaaatgctattgatccagtggagggaagaaaagagataagatgaaacaaatgaacgaaaagcacggtaaataaaatgcaaaaacaaaaaaacataaagcaaaagggtggaataaaaaaacaactctttcaaaccactgaaacatgaatggaagcgaaggcttatgctaaaacgccactgtgatccccaccctgtaatttccgccctgttcaaccttatcatttggctgaagagacctaacattaaaggacgggaaaaacattaaataatccaaacataaagcacatggagccccactggccactcaaaactcataataatgtctggatggtctggatgtttgttccaccaggtctgcttacaccaagtctcctttgggggcttactggatacctgggcttatctagctattaagaaaaacggcaatgttaaaaggaatgctctgtgcctaaaagaatggagaggaggaagaagagaaaggaaaagaaaaatccacaacattcaccttaagttactctttgagccagttcctggaatgtcagttcttccccatagaccttactatgaggtaaggtctcaaatgttcagtgtggcttccaaggcttttcagacctggctcagttgcatctcaacctctgcctctacaccattgcccgtgctggtggcctgcccagatgtctttatctccccatctgtacttcccaccaaaccctttccaagtgaagcattctctaaaagttgcttgaggttcctgacaaaatccctgtataaggaatgcaccacatggccgtttttaagtttggttgtactctgcaaaaatttgtgtaatgagacaaagaaaattgtattcatcagaaggcacatggggaaaatgggttggcctgataaggctgcttctggagagaaatgaagccaggataaggactggactcttttcctagagtatcttgccttgaacaggcctcctgctaacctgtcttatccactggaaaacatagctacagcgcttgcagtttaatatctttaagaggtgcacatacatatttgagggcttaaaagagataattgtttccaaaatacaaagagataaacatgacaattaccaaatgtttaagtaaatgtctacaaatatacggtactttttttttttttttttttttttttgagacggagtcttgctctgtcgcccaggctggagtgtagtggcgccatcttggctcactgcaagctccgcctcccgggttcacgccattctcccgcctcagcctcccgagtagctgggactacaggcgcccgctgccacacctggctaattttttgtatttttaatagaaacggggtttcaccgtgttagccagaatgatcttgatctcctgactttgtgatccgcccgcctcggcctcccaaagtgctgggattacaggcgtgagccaccgcgcccggccaatatatggtacttctttcattgttaaatctaacaaatttcaataacattttgtttcaaaatattttaaaaatattttcttgtgcatgaaaacaattagtaagttaagctgactttctttttaagaattcttgactgcatagctcctgagaaaacagagctaatcataaattgaatgacatacttacagtcaaatgatttcaaaggcccaattataaaggtgcttttcatcgcttgctgcacagattatatttaatgtgaggtgtgggtgcacgttgttatgtttggtatgctcgtgggcagaagaggaactaaggcctcagaaaatcttaaaagacctggtcccatgtacagcaggagggtgcaaagagagctggtattaataggatgtgaagcgacgtagggggaaatggcagagggtgtgtcacagctgagtggtccatttgctgctgctcgcccttcatgaatgaaatcttcaaaaaagctacagactctggaaaatgctgctttccactggatttcttgtaggggataagggtttgagtccaggtgacagagccactaaggagtgccagggcagggtgagggcccataacgagcttatgatgccaagcattggggttcaggccaagttcttcctgcatctttgaggggcagggatgccccaagtgagaattgttacctgcatttcataatatatgctcttctcaaaatgcaggtcctatcacagttgtctggagctgagggtgagttgaacatagaagtgatcaggagtctttctaagggctcccattcagaggatcccattaactcagagaaaaacgggaagagataataaacagccatcacagaagacactgatctaacaaggtctcccagcatttccacagcagccccctgtctgccatgtagggggttgagaaggtgggctgtttgctttcagttataatgggtctatgctaaaaacaaaacaaaaaactcaggcgggagtaagaagccatggcaagtggacatttctccctgtgcaaaactgatgagtgggaggcagtaagaagagagcaaactgaagtgcattatttttcatttatttttactttaaataaaaagcataaagaatttgaaaatattttgttagccttcaaccttcgagtcactttaacctatccacattaaagggccaccataaaggcttcatgaatagcagtcccaggataattcccttctgtttgcttgttcctgtgcatttcatgtctgcccacctcctgagccttgcacctgccctgtgggtttggtgcttgcacaaatcaaccccccgacccccggcctcctctaccctgccctgagaactcagcgttccatgcatcctcaggctttttctgcaggctgtcaaacccaggcatgagctcaccagggtaccagctagtaaactacatccacacagtcaggttgaggtatccactttagaaggggactctgggacatggagtacagtgaccattatacctcagttaatggaaacttgactcccagcctttaaccctgacaacacatgaaccaccccggaaaattggccttgccagtatttttaaacagaccacggatccaagttcgagacaagtgttttgcgtggccagatggacagtttcagctggatgtctcaagggcatccagtccatatattgataatatatcaataacaacaaggatcatagcaaatacttctatatatcacttattctacaatattaactcatttaatcctcgaaacaacccatgaggtaagtactgttattattcctatcttaacagataaagaagctgagaaaggttaagtaacttacccaacaacaacctggcaaggtagggactgtggagctcattttacacaggaaggaaatgggttcactgaggttaggtgacttgcttgcagaaccagaactgaaacccacctctgctggctctaaagcctatttcctttctaggactcaaggcctctccaacaccactatttctgttaagagctacatctgtctcccaatcacaaagccccaaatgtcagcattgccttgggcaaatctcactgattctgtctctggaatgtctccaatattagcccctttctttgcactccaatggctcctgctttacatttcactttcatatcgacttttgtgtggaccatctcaaactgattttacatcctacattctcttccctctctaccctcatggaaaattactcttctttaaaacacagctctacaaaatgtcaacagcagaattaccatgatatcaatttttcccccttgttctcttctgtgtttattgagttaaaggcattgagattatattccttttgtaataggaaaaaaatggcagaaacaaaacactatctaatgatgttaagtcctgtatgtataaaactcaccaacactattgctaaccacataagtgcaaactcactgagctgaactattcaagactttttacaaagagagtcaaaaatctataatttgttcaatcaatatttcttgagcacttggtacactaggctgggttttctgtaatgaatgaaagatataactcttctcttagtggagcttacagtctgttgggggagaagccattaaacacacatacatgatgtacaattacaaattgtgctgtgtgccaagaatgaaaagagcaagtgccacaagacaggacaacgggcaagagctagtttcgatggtggaccaggaatgcctctttgatgaagatacttgtgcacagagactagaaggattcagggtggcagtattagaagcaagtcaaagagtatgaagaacttccaacgcaggaggaccggtaagtgagaagacctgtgtgtaaacctgtaagccaatacctatctaaagtttcatttgatgaaatctattaagacttttaagaagaagatctggaacaagaaatccaaacaattaataggatagaaaattgatcacttctgcctctggctcaaatttgaagcacccttcaaagcattatggaggcaatgaatagaataacttcctgtgtcttgagtaatcacatcccaaatgaacagacgcataagtggatcaagcctaactaaagctagtcctgtggcatccaagtgtcagggtttcatattcgattaaaactttcacctggcattcaagggcccgcattctgattacaatctaattttccagctttatgttagttagctctggccttctagagatgagaagcagaaatccacccaggctagtgtgactgtggggagaagtggtgctttaagaatttaatgggaataaagaaaatatgaggttcatatgaatctaaacaggagttaaaacaggacttggccatgtataaagtggaaagactcaaggcagcttaagaatgcttagtgttggggctgggcgtggtggctcacgcttgtaatgccagcactttgggaggctgaggcagatggatcacttgaggccaggggttcaagaccagcctggccaacatggtgaaacctcacctctactaaaaatacaaaaattagctgggtgtggtgtcacatgtctgtaattccagctactcaggaggctgaggaacgagaatcacttgaacctgggaggtgaaggttgcagtgagccaaggtctcaccattgcactccagcctgggcaacacagtaagattctgtctcaaaaataaataaataaataaataaaataaataaataattcttagcgttgggaggcaattctccataacgtttctataagtcatgccagactatattttctgggatatttgcatagcaaacagcctaggaaactaaagatagtgttcccctgcagatcagaaggcacatgtgtttcctgactagcatagtaaagacagagaacatcccctgcccagagatcggtttacattccagggtaataagctttattaccctggaatcagccgtctctggaggggaggataggcatgtctccttataaaattggggttttctaaagctcagtgttgctcagctgtgaaacagacccctatgtgcacagtatccacctaggcccacatccccatcacctccatgagacctggggggccagggagaactgatgatgcagacataatgctcatgctgcctgatgtaccacgagtaataaactagataggtacatttgggttcattatttcctttccagctgatctagtagctttctattctaagctgctccttaggggctgcttggccacctgacccttagaagcaagagttcgaagatttttcacttttgcgtatgccattaaaatgactcaactatttccatagattcttcatgtacatctttctcaccctgatgctatggtctcttctctgcttattgattctgctatgctatcatcatggcttctgccttctcttaacttggtcttgctcatggtcttttgtgtgcatccttgtagatttcacttctgactgtctgataatctttacttccaaaaccaaacttctgagagaaataacctattgggacaatgtgtccctgaatggacagggattttcaaggcaggccagtccctaggtctgccagtatgcagactggctccccttgagtcaggtgaccatcatgatgattatttatctgctgtttcagcctcaaacctgccctactacatttctctgtgtttcccctgcagctggaagtctgcaaacaactagctgtttcctattatgttgtatccatgggaggcagaggagggacagcatcaggcagaatacagagagacttttcttgcatttagctctaacttgtgaaaactgctgtagtagcagcaagggtaacggtaactcagaactccaaccatatcacccaactcagcacaacattcaccccagtggatatcaaggtacactgcaaacataatgttttacacagagatccaagattggtatcacatctctctttttatatttatttatttatttttgagatggtgtctcgctctgttgcccaggctggagtgcagtggtgcaatcttggcttactgcagcctctgcctcccaggttcaaacaattctcctgcctcagcctcctgagtagctgggattacaggcaagcgccaccacactcggctaacttttgtatttttagtagagacagggtttcaccacattggccaggctggtctcgaactcctgaccttacgtggtctacccatctccgcctgccaaagtgctgggattacaggtgtgagccactgcgccctgcctggtgtcacatctctaaaggggtcatggcatacccatcgagtagcactgacaaccaaacaggatgcccctttgcttatctagaacactatggaatgtggtcagcacagaaaggagaaagtgcagcttacataacgtacacatttcaaggctgcctgtattcacttatgttgtgccagggctgacaaattgactggcatagggctataccattacatgccaggggctcagaattgttcctacttattctggaaggactggtaacttacacagactaaaagagtgagacatgatgtttcaagtgataatatctagcggggattttagataatcatggctcccacggtagttttagaaaatgtggatactgccgcctggtcttcttcctagccattttgagtttgctttccagcttttcgctggtgcttcatactcactttttgcactggcatagccttttgtcaaccgtatttccatttacttctcctagtccgtctttccctttcacttgtggttttcttcccttgtcatttaagcattctcaactacacatagaaatccaacagaagccttttgtgtgggggattccctcagtcccaggcagtcctgaaagcagcaggtgtctctgcaaaggcttctgtcagaccttagacttatacccagcagctgctaatcctgagctctcactcttaaaaagcagtaaaatagacttcagtcaaaaacaagtatggtgggagttaactccctcatcttgagctcaagccacacttgccttgaaattttccaaaaattcactaagctaatttctctcactatggaaagagagaaaggctatgttgctggtatacaatgctgcctgtgatggaggtggtgaggcataaatttccctaatcggaagataaaggctaaccacgtatgtgggtgatgggggttggaggtagcttccagggcactggagctacaagtagaagcacaaattttcctggctggaaacaggcccctagagggaaacatcacaccagataaggaaataatctttttttttttttggtccaacagggcactaaggctcattatcatatgccaagtaatgtccacctatacaagaatacacaaactaacttcttatgttattaacacaaatgtatctctaaaacagtcacataagctaaaaaacaaaacaactattaaacttgactttatattgtttatggattcattcacatatatagtaaatattctttaaggtggtgaaacaagatattaggacagctacttaaagttcaaaagagccaatgtgcctcttttgcccactgttttgaaatggtgatgcagccaaatttcaatccatcaacacacttcccctctgcattgcacacacaaagcatcacctggctgggcctcttgttcgagctctctgtaaaaacatagaattccatagcattactttaacagcatatggtccaatccccctactacagatgggtgaactaaggctcatgccttcagtgagccaacaggtatagaggacctaccacgtatcaggcgaagttctagaccctggggagaaaaagatgaatgagacacagttcttgtcctaaaggtgctcatggtttagtgagagagattagacacagacacacacactcacacccctgcaataaaatattaaaagtattattatgtgtgtttgtggaattatgagattccttgcagattaagaagcaactaatagtgtttgagagagggactcaagaagagtttcccacaggagatgagatttgaatgtgggccatttaaagatgaataggaatttgtctggtaggagacaagaaagggcatttgaagcagtggaaacagcatgtgcaaagacatgtagtgtgaaagcacctgttctcttggggaggaacctagggtggctcaggagctgggagtaaggagtgggagaggaggtccagatgggttccttgacttgccgtaaggtcctacagcaaaacaactccaaagcccacctaattaggtttcttgactctcactccagtgctctttacactggaccttgatgcttttagcaccaataaaatgtagccacgtgaaactagaatcatttttaacataataaataccatcgatgctgtaggcacaatgggtagcttaaaagagggtctgaggaaagcccagaaaagcaaattcgaaggagaaatgtaacaacaatgacacctaccagaataaaaagagtatttatcaaagccctagatagcacatcatacagccttttttttttttaattcagaaaataaaggataccaggacagaggaagatgataataatagtgataataattgcaacaaacggtcctagtgtctcatactttaaaaaaatcctcctttgtatatattatttcttcggaacgatgagataattatgtagtttggttaaaattaatatgcaatccataactaaaaagaagaagacatattatttacaactgttcatttgaagctatcactgttgtcaaaatataaatcagatgccttcatgatgaggaatttggcacaagttccacataagccagaaggttagaaaaagagaaaaaggaagtgtattcatgctattcactaagaaaaaaaagttttctccacagatgatgggaggctttgaagttgtgcaagagagcacagccaccgacaaggagaaatgagtgtgcagtgtactgttacagcattttggggcccatgttgaatttgccataataagtctattttctgtccaaaaaatggtcaaactttttattttcagagattaaaaaaagacatatatctgtatcaaccattctttttccatattctaaattagaaagataattccttaaaaatcaatataggtggttgggcacggtggctcatgcctgtaatcccagcactttgggaggccgagcaggcagatcacaaggtcaggagattgagaccatcctggctaacatggtgaaaccccatctctactaaaaatacaaaaaattagctgggcgtggtggcaggcgcctgtagtcccagctacttgggaggctgaggcaggagaatggcgtgaaccaggaaggcggagcttgcagtgagccgagatcgcaccactgcactccagcctgggcgacagagcaagactctgtctcaacaacaacaacaacaaaaatcaatataggaatttgcctatgttctaagcacctttatttgatatcactacttttataggcatatctcttttaaagtcttgtctgagatacctaaatggaaagtagtttactcacttcgctgctcaaattgagaatccttgtagtgaagaagaaagaattttgcaaatgagatttgagagtagagagggatgtccatgacatcttaagagcaaattgcagggtatttgcacattgctgtttgtgcctgtttgtatgaggaaggagaaagttgtggaaaaatatgagccaatttgtggatgctggttcccactgtggggtaaaaatgaagggggattacggaagagattaacttttttcttcatatatctgcataaggttcacactcattataatgatcataaaatgtcacaattttcctttaattgaatagaaaagattaaatagaaaaaacttgacaagaaaaataaaccctaagaataaagattttttaaaacactaaagaatggatttaccaagcattccctgagcaaaatgtattccacagcaaagaaataggcccaggtatcaaacaggtagtctgccagcgaaatgctgcccaagtgactctcaagatgaggtctacctaaaggttttcagaaatgaaattcatctagcatctagcaccataaattagcagaccaataggatttaaccatttaccaaaactgcatctgggaactgataactgccaggcatcatgctagcaggtttacagcaattactaattgcatctggagcagaaggtaattaactccagttttagagctatttgggtttaatgtactaactttctgtcatgaagctgacagataaaaagaaactaagtatgaagcatgctttcagggatatgtctccaatgtttgggagtctgtgtgggtactgcaggggaaagggcaacgctttggaacaaagcaatcctgcatttaaattctggttcagctattatttgctgtgtggcctggacatatcccttaacttctatgaacgtctgatttctagggtgcaaaatggggataagtattcctatcttacaggctgtagaaggaaatgagtaagatcatatactaagctacttagcagccacacttggcaagcaatagacacataataaaggaagctattattactaaatcattccagtacaccttgatcaagagtgggctcactctgctcaatgtatgtaagaacatacatttgggattttttgttttgtttggttttttgagacagaatcttgctctgtcacccaggctggagtgttgtgggaagtcagggaccccaaacggagggaccggctgaagccatgacagaagaacgtggattgtgaagatttcatggacatttattagttccccaaattaatacttttataatttcttatgcctgtctttactgcaatctctaaacataaattgtaaagatttcaggctggtcgtggtggctcacacctgtaatcccagcactttgggaggccgagacgggaggatcacgaggtcagaagatcgagaccatcctggctaacatggtgaaaccctgtctctactaaaaatacaagaaaattagccaggcatcgtagtgggtgcctgtagtcccagctactcgggaggctgaggcaggagaatggcgtgaacctgggaggtgaaggttgcagtgagctgagatcccgccactgcattccagcctgggcgactgagcgagactccatctcaaaaaaaaaaaatttcatggacacttgtcacttccccaatcaatacccttgtgatttcctatgcctgtctttactttaatctcttaatcctgtcagccgaggaggatgtatatcgcctcaggaccctgtaataattgcattaattgcacaaattgtacagcatgtgtgtttgagcaatacgaaatctgggcaccttgaaaaaagaacaggataacagcaatgtttaggaaaaaagagagataaccttaaactctgaccaccggtgagccgggcagaacagagccatttttctcttctttcaaaagcaaatgggagaaatatcgctgaattatttttctcagcatggaacatccctgggaaaaagaatacgcacctggaggtataggcttataaacagcccccacccaggtgcacctgtctcttatggttgagactgcaggggtgaaatagaccccagtctcccatagtgctcccaggcttattaggaagaggaaattcctgcctaataaattttggtcagaccggttgatctcaaaaccctgtctcctgataagatgttatcaatgacaatggtgcccgaaacttcattagcaattttaatttcaccctggtcctgtggtcctatgatctcgccctgcctccacttgccttgtgatattctattgccttgtaaagtacttgatgtctgtgacccacacctatttgcacactccctccccttttgaaaatccctaataaaaacttgctggtttttgcggcttgtggggcatcatggaccctaccgacatgtgatgtctcccttggatgcccagctttaaaatttctctcttttgtactctgtccctttatttctcaagctggccgatgcttaaggaaaatagaaaagaacctacgtgaatatcagggcagattccccaatactggagtgcagtggcgcgatcttggctcactgcaacctccgccctctgggtttaagtgattcttctgcctcagcctcctgagtagctgggactacaggcacgcaccaccaaacctggctaatttttgcatttttaatagagacggggtttcaccattttggccaggctggtctcgaactcctgatcttgtgatctacccaccttggcctccctaagtgctgggattacaggcgtgagccaccatgccctgccaagaacatacatttgtaacagtgccacccctccccctattccacataagagttgtggtcatgtgacaaattttggatcctgaagatcttgttaaaatgcaaattatgattcaacaggtctggttcaggtgatgcatgtgtagtgaactgctggtgatgctgatgctgctagtctgtgggccacaatcagagtggcaaggttcttgggaaaaactgctatatattaaaataaaatgggccaggcaaggtggctcacagtgtaattccagcactttaggaggctgaggtgggaggatcacttgagcccaggagttcaagaccagcctgggcaacctggtgagaccttgtctctacaagtgatttttaaaaatcagctgggcacagtggcatacacctacagtctcagctattcagcaggctgaggcagaaggatcacttgagccctggaagtcaaggctgcagtaagccatgattgtaccaccacactccagcctggtgacagagtgagaccctgtctccaaaataaataaataaatagataaataaataaataaattaattaattaaatgaatggagctgagggagtcaggagggaccgtgaggcagggttagctactccatccctgttcctgcatgcctgagggacatttccaccatagctcgtgccacactgtattagttttcccatgcctgttccactaggctgggagctccttgaagacaaggaacccatcctgatggccccaagggactgctgaattcaattcagacactcaattcaggctatgtgtaaacaaatgaagaaagtaatgaatccatgaatgtatgaaattcatgtaatgaatgaaattaagggaaatgactgttggttagtgtattaaagtctaaatgggttcaaacttcctgtttccgaattactggactaacttcatatattaccagtattgagagtattaagtgctttattgtttgatatccaggcaagagaactatcaggaaagattaatcctggacattcactttagaaagataaagtttcaagagttccctttactgtaacacacaaaagaaagacccagaactcccttttctcaagggacatctcctatcctggaggaacagtaagtacagttcccagcatatcactaggacaacatcatttacaaaacaatcatgctggcagcatactgttataattagcatagattctcttctaaggcacatagaagcgttatctctctatgctaatcactttaaaggttctgtaagcaatatcactaaaaacgagcaaaaaaactctcattacttgtatgacaaaatacagcaagtattccaactgagttgtcacatcagtgtccatttttacaattaactcatgctgtgtttacatgcttaatcctactgcaggaacaagtggagattaagtttgccaagtaaaccactatagcaaagtctggttttattgccaggagatagaaacctgttaaactcagaaggaccactgaaagtgttaagtttcaatggacagcaataggaagcacttgcccaaacgtgatctatttacatagcatgcattcttctgatcagactctcaggttattcgattggtcagttcagggcctgccttcctatggctcttttgttgcaaagtgggacgtcacatgtaaggacagtataatgtcaacttctaaacttctccaggtacatgtaaaagtttagttctacagcctaaatattaaaaaatatggatgtggttaaccgtggttcatctcaatagaataataggactccaataaatatgaggcattccatttaaaatagggaaactgtaattaggtgtgttttaaaatttagctctggtttaatcaagtcagcctaagcagtccaacatattagtctttgtcagtaaaggaatccatccactctaaactctccctgggcttctgaagaactttaaaattgttcattaattaatgctttcagcactcctacagcctcattatgctgttgttattaagcattttattttcttggtcccaagggttcccaaagcaaatacatgttccccagcagacatttatgttttcctccagaagagttggttttccattcttgatctaaaacaaatgttaattaaaacgatggttaatatggcccacacttttcccaaacattttcaaagttggcagcattccattctcctcttcctatattccaagaaactccagcaagtgattagtcttcttcatagagtaaaaatatctagacaaaagcagtcaaagaatattctgagtagcttcccagaaagatattcttagaaaagctccctgtttggggctcttatacatcagagagcttcaattcctacaaactttgtggaggttactttaaaggccaactaccttttgactcacaaatcacttctgggaaattttcctaaggaaaaagcatagatttccacaaagcttggatgtgaaagcttgtgaatgtctttatcacaacattgtttaatatttaaattcagaaaaacctaacttcccaaaaatcatggagtatccatactatagaattctatatagacatatgaaaagctttaataaaatatttaaggatattaaaatatttatgatttagtattatacaaatataagaagacaatgagaataatttctagaattatcacaatttcctaaaaaatatatatacatatttgactgtaaagaaataaactcagaacttactaataattatgtctagtttcaggtgattttaatttcttttctgtactttcctaaatttttgtagttttatatgttctaaattaaatatatattactttgtaattaaaatataaaatgttttacttattcctttctcttagcaatgtgaatatagtcttcctacatggggaattaatcactagattagtaggaaattaatgaaattaacaatggatgaacaaaaagttaacttaccacatacatttggctttaacttcttgtatgtaaataaattcctcccagtagattctctaccaactacctccagtttctattagctgatccttgtttagaagcagtccactgatttttagtaaatcaaaatgaaactccaagaaagacaagaagatgaaatgtgaaaaggaagctggccttggtgctatgcacagtgatggaaaccatgaatatgaatagatggagcattcggatagcaggataatagaagagggaaatgcattcatttgacagctgccaactccccctccctgcactgtcacttcccggctgcccacccccttctccaggccttgattcccagcccacagaaacgccgtggtgcgtgtagcctctatggtgttctcacactccaaaagcgcagaaaataaaaggccactatgttgaaagcttgtgcctcatagagtaacaacagtgctaaaagtgcttaaaaatacgttactacttttcatatcaatcacagcgttttccaagctactccccaacctactgtgaggtacaagggtgagcattgtttaattggctttgggagtcgtatgagctgtgcgagacctttaattagaggagctggtggaataagcgtgtgatgtgtgtgttagggaggggtgggctggttctgccatggtctttgtaatccctttgcaaatgcacctttggacaaacttaaaagaaagtagaggaaagttagaagaacttgcttcttactaaaagaagttcaaggtagcagtaccctaggttttgttcatgtgcctaatctctgaattcaaataccacttaataatgatgcttaaactgtttattctcaatgtcagaatgttctcatctaggtcaacagagaaaaccctgatttgtagtactggggtctcatcccagagactgttggtgctgaggcacatgcaccattgaaaggggaaagttattcagtactagcagcagttgctatgtagagataaagacctgacattgctggatcttatgattctttaagcgtaattggaaatctattttttaggtgaaatctgtatttttataggttgataacttaaaagaaaaatcaacactttctatgagcaaacaaaacatctctgtgggccaaaataggcctgtggacctctgattcaggaagaagaggatcttaacacaagattttttaagcacattttaaagtgcaccaaatttatctgtatatgcataaattattatccaataaattcagtagaaaagaaccatgaatttaaattctaaaccacctgaccaatttatctgaatcagctcctaaaatcattttgggtctattttcctcctttaattaaaataagaataatctactaaagttttacaatttaaatattgacaattatatttatttttgcatctcagagccactgctgatgtatttcttttatgtatgaagagactgaggaacaaggaaaaatcacagaaaagccagaggatgaagctggaatgcaagagtcctgtctctttatgattcaacaatcaaataaaaaccttctctaaaaaatgaccaagaaagcaagcttattaggttcatgaacagagtcatcacgtaaacaaattacttctataatagtcccagtaaaatgatctcaggttcttatttaaaactcatggaaaggaaatatgtcaggttaagacatctttatctgtttttaacaactggaatattaatcatatctaattcaatgtatatttcaaaatgagtaactcacatattcacagcactgtccaaattaatgaacaggtcccattacctaggactcatactttaacatttactaattcgctttccacactgccatttctcgttagaatggcaacttctagtttgtgaaggaaatgagtcattccatgcaactatcccaccttctgaaggacaagtcacagcaggaaatgaatggcttttggtttttttttctgcactagtacagaaaaacaatgtatctaatactgaaggatctgaactttgggacaatcactttttctagatattgtttgcaactttcagaacattcttataaattaatgtaaattagaattataattttgccattgtgttatgttgaaatgaaatctacagctatcactaaatgtttatgaattttccatctacaatcaacctttcaattagtcttatacaaagtcggtctcaagttagatttctggtttttacatctaacttaaatgcatcttgtggttaaatgctgtggaaggtttgactagacctcagaactatcaataacttataaataatggttaaaaatcaccattaaagtgtgtatagcagaaacctagaactgaaattcacttgaattgagtctggttcaccttatttagtttcttccttatttagtttcaaattccctgtgctgggttggggggtggggagaaccctgtgacttatagatatataaagtgtcttgtgagaaatgcaaaattccttcgtaaaactaccttatcatgctgtccaaattatagaaagcacaaacaagtgtcctcacttagacaaaaggctacagtaaccaaaacagcatagtactgataccaaaacagagatatagaccaatggaacagaacagacgcctcagaaataacaccacaaatctacaaccatctgatctttgacaaacctgacaaaaacaagaaatggggaaaggattacctatttaataaatggtactgggaaaactcgctagccgtatgtagaaagctgaaactggatcccttccttacaccttatacaaaaattaattcaagatggattaaagacttaaacattagacctaaaaccataaaaaccctagaagaaaacctaggcaataccattcgggacataggcatgggcaaggacttcatgactaaaacaccaaaagcaatggcaacaaaaaccaaaactgtcaaatgggatctaattaaactaaagagcttctgcacagcaaaagaaactaccatcagagtgaacaggcaacctacagaatgggagaaaatttttgcaatctacccatctgacaaagggttaatattcagaatctacaaagaacttaaacaaatttacaagaaaaaaacaaacaaccccatcaaaaagtgggcaaaggatatgaacagacacttctcaaaagaagacatttatgcgaccaacaaacatatgaaaaaaaaacctcatcatcactggtcattagagaactgcaaatcaaaaccacaatgagataccatctcacactagttagaatgacgaacattaaaaagtcaggaaacaacagatgctggagaggatgtggagaaataggaatgctattacactgttggtgggagtttaaactagttcaacaattgtggaagacagtgtggtgattcctcaaggatctagagctagaaataccattttacccagcgatcccattactgggtgtatacccaaaggataataaatcatgctactataaagacacatgcacacgtatgtttattgcggcactattcacaataacaaagacttggaaccaactcaaatgcccatcaatgatagactggattaagaaaatgtggcacatacataccatggaatactatgcagccaaaaaaaggatgagttcatgtcctttgcagggacatggaggaagctggcaaccatcattctgagcaaactaccacaaggacagaaagccaaacactgcatgttctcactcatagatgggaactgaacaatgaaaacacttggacacagggagaggaacatcacacaccagggcctgtcatggggtggggggtggggggaaggatagcattgggataaataactaatgtaaatgatgggttgatgggtgaggcaagtgaatcacttgaacccaggaggtgtaggttgcagtgagccaagatcgccccactgcaccgtagtctgggcgacagagtgagactctgtctcaaaaaaaaaaaaaaaagtgctatttgtgagatagggatctacatgagcaatttaatgtacttccagcaagggaaagtagggaatcgaaactgttagggtagacttttgtttacttgacaaaaaaaagagaagttattaggcaaaaggaattttaaatattacagttcaagttttacctgtgtagtccttgatgctctttcaggaaaaaaacactcactctcaacaaaaagggcaaagactagaatctgaccctgtttgtccttccctttttttgccatcaatttgcctctcttatttcttccatatatacacgatccttctccctacaaatgtgacagatctccagtttctagtcatgatttgctaagcatagtgctgcatgctctacttacatacttcactgcctgttttcagatcaaaagagacaatgagcgaattctccatttcaaaaccacagcaatctttatatcctcaggtccagcactttaggacctggagtcattgatctaggtctcccacacaatatcaaaccaaataatacttaatactaattccaaatacctcttccctattcatatacttattttaggatttaatttatctttcactctttctgtgaagtctagggactggacagctacctcttcaacttgtcatcctgtacttagcattttacctctgaataactcacaaactacagtataccccaaaccagattaaaggtatgcattggatatagtgtttaagcacaaaaacacccatcagccaactgaggactgttgtgtgaagactaatgtcctgagatggccaagtacacatcaggtgtccctttcctccccaggaacacggccagggcagccatcagctaaggagacagaagcttttctggcttcagaatctttcttaacacagcctctccaggcagccactactgaagggtcagacttggtcctccagatgaaaagcttttgtcatgtggcctccaagccctcaatccaccaggatgcccaaactaaattcttacagatgggagtatcttcagtctttctaaagagaatgtcacaggaaagtaggcaggaatctctttttatccaggttttagcctaagtgttaagatcagcaattctaaaacatggtgtcagccctttgtgacaaagtcctctattatcctgttcatctccctgctgaattcttagcaacctctctcagagatctgcagaccctttttcttgggggaaagaggtagtttcccaaagctgtaagtgttagttcagagaatgagagatgctgacttcattgtttcccaattcagtgaagcaggagccggacttcaggcatctaattctcctcaaataaagagctaggggtgactagactggaggaagaacatgacacacgtgtgaggtctaagaaccagaagaaaaaaggagggaaagggaaggactgggagttgaaaaaatttcaatttgcctttacatggtacctatatttcactagaggaaaaattgaccacgaatgtcaaatgtagtaacttttcatttcaagttcttgtcctctccatctgctccaattcagagcccaaatgcccgaaaagggcaagataagataaagtaacgagaccatcaacttctcgcaaattaataagttaccataaatgaaaatcaaagtggaggcggatccagccccaactggctgctgttctttgggaaggagaggtggccactgtcctagaaggcggccctgccttctccgtcagcagcagcctcagtcagctctcctgcgctcctgtctcttcttcctgcatactctgccccagattctgacttgaaccttgctaaaatactgattagccctctgtaaagtttggctgtccagtggcaccagaatcatagaataatcagggtagtggaccctgtaatgtgccatcagattcctttaggactagggcatttattctcccagttgggagtgttagaggctggcagctttcagctgagggcctctcaaagaagcatgcttagttagagagagccaccgccctggagggagtttgccctcttgggattgggcaacccacagccaatgactggctgatggagaaacataaaggccttgcccccttgccttaactcgggaccactcttcaggctgtcccggctccagagccccctgtgcatcacagccatcttctccctctgttccgttctcctgctttcattcccctgccagtccttgtggccataagcagtccctaatgaacctcctacttgcaaatcacagggtctcagagtgagattcctggataactgaactgtgaccatcagacacaaagtacaaatagtgcttcatcatcttttgctcaactttaaattcatacattatttactgacatccctaatgcttgcatcagccacatttatacgttggtattcagcaaacacaagaggacatggctaggctgcctgtcccccagtccagtgataacaatgctactgcaggatttgcaccatgattttaaaagatgcagtcctcattttgtgtggttctgatatgcacccatttcagtgagcacaatttaaatgacacccatcctacaacaaccctgttcaaatttcagttaccacaagatattatagtagtaactgaatgaagtatgctcttcagcccacactacaaaaatgacagatgcatagcacaaccagtggccaatcacatcacttctttcaaagactgtcagtgactggcctggtcactgcacatctgagcagtagagtgatacttggccctggggcttggggagataaaggaaggacagcaagaaagcagggcacactagccagagggtggttatggatgacctccttgactatcagagtcctgaacaggagcagggccttagaaggggtctggaagcatgtcaatccatccacattcaagcacaggaaaagtgggaccaatatcaaacctcattattcatttcccacccctactgtaacacattaccacaaacttagtggcttcaaacatcataaggtgattttacagtttggaggtcaggagtctaaaatgggtggcaaggctgtgttactgctggaggttctcagggagaatccacttccttgccttttctagcttctggaggctgcctgcattccttgacttgtggccccacatcactctgacctctgcttctgtcattgcatctcctcagactctcgcttgcctgcctccttctcataaggaccctgtggctacacttggcccaccctgataatccagaacaatcacccatctcaatatctttagtgtaatcgcatacacaaaatttcttttggcatgtaagataacatattcacaggctttatggatgagaatgtggacatctttggggagctattattttacctaccataccgcatcatgtttttgcaaatgactggtgttctcctggacaatgtcctgcattcagctgctagaatgacagggctgcctgcaaacatctgtgtccgtacctagacctccccgggaaagggcaagagtgaaggaatgacggcctggtgttcctgccccaaatcagcttttcccaaagggctgcttaagactctagtccctagatacattctacattaaaacctaccactttcccgtgaatgtgggaagtactgcattcacactctccttcttggacactcacaattcatattagcataacaaagatcctgagatgttctgcagtaaagaaatctctttgacttgcttaactctgagttttctaaatgtattttcacataaaataaatttaggaagaagttgggaatgctgtactagcttatattccaactctggccaatgctgtgcaaacagttctgcatgaagtccacagacctctcaggccctcttgaaagcttaatgcatgaagctgtcttaccagaattatattaattctcctggagtggtttcttctcttgcaccagcccttggatgcactttggcaaaccctgaaactgcctattgactcacacgtgcaaagtatatgaagtgacacattcttcaggtgtctcagctctgcctggaaactcatttcccgtagagccattttttccccctctctcttccttctctttgactctggctctcaaaactaaggggaaaaaaatgaccaggaaataacgtgtcaccaattacacgcatgggcttttacctttctctctcttagctgtcaaatcaaatgcctgggcagattgccacatggaaactaaaactctttttcatttagcaaatgaggtgctgttatcaaaacagagaagcattgccttattgctggtgtgttccaggctgcagctctggatcgctactgcagtgggatggttgactcacaagtttttcttgggaaccactggaagtcttggaggaaccacagaatctcaaacagaaggaaacttagagatcactcatttaaattttcttctggaatcctagactctttatttaatatccccaattaagaggcttttaattcatgtttaacatattttacaaccatcatctatctttcaactactactcacttgaacaaaacttccatcctagagaaccaggtaatttgccaagcccataccaggctatgtacctcttgcctgtgtctgaaatgtctcctctcatctacccccatttttcatcatcacaatagccaatatttattgtatatgttcatattctgtatggtaggcactgtgccagaccctttaattatgtcaacttatttaatcttttttttttttttgagacggagtctcactctgtcacccaggctggagtgcagtggcttgatctcagctcactgcaacttccgcctcctggatttaagcaattctctgcctcagcctcccaagtagctgggattacaggcacccgccaccacgcccggctaattttttgtaattttagtagagacggggtttcaccgtgttagccaggatggtctcgatctcctgacctcgtgatccgccagcctcggcctcccaaagtgctgggattacaggcgtgagccaccacaccccggctaatttttttttttttttttttttgtatttttagtagagacggggtttcaccatcttggccaggatggtcttgaactcctgatctcatgatccacctgccttggcctcgcaaagtgctgggattacagggatgagccactgcgcccagcccaacttatttaatcttgaccatagtcttatgatgtagtattgctgctttatagacaaacaagcaaaattatttactgagttttactgtgactgataccatttgctgtgtgccacatttaagacactgtgctaagcattttacatttttatcattgtgtctatgagtcaatgttatgattcctcttttgctgatatagaaacagaagcttccatatgatgagaaattcatccgtggtcatacagctagtaagtggcagggctgggatccaagtgcacaagtatcttctattcatacttcactcctaccttcttgttttctttccagccagtgggatcctccgtgtatctcagaattcatagagcacttacttgtcagcccagtcttgttattgtcatattgtgcacagtagctactttctcctcactggacatctcttacggtactttgcatcccttaccatggtgcttacaatgcgcactccccaaatgtcaactggtctagaacaagtcttcttacagcaaccaggactggcatggacatttttctgatgagggatttccaggtctcagttgatttcttggttatttcaggatgcaactatacaatggcattcagtacatggaatttaatgcaatactttgtcccttgatgcttgttttaacagctacagaaggagagagtgactgttaggctgagtcccctcagacctactggggtggctaagtcgaaagaatctctaggagtcagttatatctcaacatgcagcaaaatgcccagcacaaagcaggtgctcaaaaaatatcttttgaagaatgaccatttacaaataaagtcatgttctacagactgtttaaaaacgatgatctcctttcatctctgaagtgattcttagaaatcattcatccagaaggtttaagttcttcaagcgattaaagctggtaattacaataattctattatttttctgttgaaatggatttagcacacagatgagtttttgtttatctgttttgtttttaaagatttcaaggtaactggttaggaggtatagaagagggtaccaatagtgaattgctaaattgctgcaaccaggagttctgcagcattctgggggaccaaaggaattcacttgggaaatacgactttctctgtgatacgtactcaggatatcaaaatcctatggacaagttcctgaagaaagtattccactgatatgagaataatgcctttgggctaaaacatactgtcttttgactgagtttcttgaaatctctgtactaaatactgatactccacaaataataaaccataacaagatctaaactgaaaaggttttataaagtatcacattaaaaaaacgcaagggttgttcagagtctttttcatccattaagacagaagcttctccagaagctgaggaatccacgtgtagggaccattcaagaagtcctggcaggatttggagaagagtgaagaggcagtttccctgggaacatggctgaagcacttccagaaaaaataaactcagggggcctacatcaccaaaggcaagaaattaaaactaatttttttcattttgaaggctatttttctaaaactaaataaaataaattgaagtatattaaaatattaactcacacacaaaaaaacgagtgagataaggtgtcagatacccctaataaatgcaagtgggaaatcaaagggagtctcagacaggcaggcaaaagactatgctgactttaaattaagtttgtccccagacagcgatttgtagacagagaaacaacattaatgttatgcttaaaacaatacagtaaatcacccagtctaaatattgaagaaaatagggcccattgaggctgttttccaaggtcaaacacttcattagaatagaaccaaggtctcctaaaatgctaatccttccactactcctgggaaagcaaacagctccagttccagttgatctgtctggaacaactggagaaagcaaggtatgggcagagcaagactgagtgctgtcgtcagttggcgatgtctgccgtggcattatggaaagaatgatcatccacatgccacagatctgccactctccagtgtaccatgccaccgtctaagtctacagaaaagccagcaaaattgttgagtgactaatacagatgcttttagttttcttaatgctcattattcacatgtcatcccataaaaatacataaatatacacatacattaagagatactgtaactttcatagttccaatgccaagccttagtatcaacacatatttgctataggaaggaagggaggaaggaagacagggagagagagggagggagagaagagaaggagggaaggaaattccccaaatacttcaagttccccaaatttaaagaagcatgaaatgaaattatcagcccaacaaattaattaattagtttatttatttatttttacttgagacggagtcttactctgttgcccaggcttgagggcagaggtgcgatctcggctcacttcaacctccgcctcctgggttcaagcgatcctcccacctcagcctcccgagtagctggaattacaggcatgcaccaccatgcctggctaatttttgtattttcagtagagatgagttttcaccatgttgtccaggttggtctcgaactcctgacctcaagtgctccacctgcctcagcctcccaaagtgctgagattacaggagtgagccaccatgcctggcctgttttttgtttttttggaggttttttgagaggagtctcactctgtcacccaggctggagtgcagtggcacaatcccggctcactgcaacctccacctcctgggttcaagcgatcctcctgcctcaggcccctgagtagctgggattacaggcgcgcagcaccgcgtccggctaatttttgtatttttagtagagatggggtttcaccatattgcccaggctggtctcgaagtcctgacctcagatgatccacccacctcgctctcctaaagtgctgggattataggcatgagccactgcacccagcctccaacaaatttatgtaacagatttgagtaacactatgtacttaactaataactttctgttcaatggatttgaacacatctttctccagttgttccaactttcagtgactcatttgatgaaaatcaagaagcttatgtggtaatagaaaaagagaaagggggaagacaacaaaaataaagaggacaaaaggcattttacaatataaaacatttgagtttttcgtatttctgttttgtttaaaatcagagaaaacactgaaattatgatgtgatcattgttgctgcttatattacctaaccaagagtaactgtgcaatcttccagtctgtagtcctccctgtattccatcttaatttggatattggatttcttttctaacattgtcttctttgtatgctctatttagatcagtgatacacaaagtatgttccccaaaacattaattcctcaggatattagtaagtgtgatctttttaaaagtatgtagtcaaataagtttattatattataggttagaccagtttaacaggtgccttgctgcaagatattgtaggcttttcatatactaacatatgctgcaagtctaaatatatatggtgttctaaatttctttagctacaaaatctttcttttgtggagcttttagccaaattagtgtttcatggagccaatgttgagcaaatggatttgaatactgcttcatctcaagatgctgtactgaaaatcagtccatcctctcttttaatcacatgatgctctggtgctacccacagcctgtctctccaccaggatccaccaagttccacacagtgggggtcaggagatactccctgaagtctactgcagagaccttggcaggtccctggctcttgcctcttctcacaggggcattagtgccttttcctccttttgccacagaagtcagaaatgaattccagccacaccctgggatcatatttgccaggtcccataagtcaggtcaagcggcagggactcataaacagtttccagcagctaaactgaccgcatggagagggaaagaatctcactctccacaggcagaagaagggacccaagtgtgtttaactcatttttgtcagaagccaggaatctttaaaagtctttctcaaaaaagctatttttgagaggttaaggtagtgatgctattaggtaaaacattttcatctttgacaaaaaaaaaaagaaagaaagaaaaacatgagacactcagaaccctttattttatacttaaataacagtttaatagaaaatcaggcagcctttagttcggtgtgaactttgccaggttatgtactttttgcagccttggttcttcagccataaaatggggataaaattgtccatcctgcagcattccgtcagtgataaagtgaaataatgtattcaccggtaacactgtgctcaatgcatgcttcatgcccagttcagcatcagctgcggatgttggctcctgtgagaaagaagctccatgggctctgctttttaaagaaagcaaatgacggtaccatcctaccaaatagatttcttccaaggaaagtatgttttttttaaaaaaaatagcaaattaatcatttagcttcttatttatgtagccttgaaaagaatttaaatccttcatttcaacagtacttctactctttcagaaaagaaatcactagaaagctgcctatggctgacaactccaatcctctccagaaggattttttttcttttaatctctattgggcatctataatgtgccccattatgccagcccaaccccctgatctaacttataccagtctcaatgcattttgattgctagattgtttttctaaatagatcagagatgggctaactgttcaccaaactattccctctccttcctgggcacctgactacatttcctggcatccctcgcacttagctgtggccatgtgactaagttccagccaatggaatgggactgacagtgttgtgtgtccctctaagcctaaccatataaccttcccatgcacactcctccatgctcctgcccctttgctccagcctgacaaagataaatcctgcaagcctgataaaggaaaccacatggaagatggcggggccacaagagggaaagggtctatgtccctgaccactgcttataagagacccaactgcagctcaagtaccctggttttgagctgggtacacatgaggaatgcttctatcatgtttaggccatcctataattttggatgttttttacagtagctggtgtctgaagcatctggaagtcctgagatttttgcagaacattatgagattatttataaaaataataaatcgaattactgtgtgccaagtccgagactcaggcactaactcataaaataactaaataatctaaaactaaggtatcattataaactaggttctactctaagtaaaccatcagagatgccaaaagtttaataaaaatattgctgaaggttgaattttctatgtttcaaccttaaagtatagaaaattcatttcatttatttagtttttctgtgacacaagaaaggctagcattgcttgactccagtagcagggacatcttgattcaccctgttaaacactactgtttcatgggtgtatagtttgtgtcggagaattggtgcagatagacatttctgagtttttgtttttaaatcaaattagaattggcattgtcagctctaggctctcatctacatttagtaaataatagattaggatcactttttttcacttcacaattatatgattatattccattatgatttgactgtagttatccatggtttaaatcaatcatgaaaaacattattttatctaaatatcataatgtataggaatatgcatttgttctatgtacacacaggaaagtacatcagggtatactctaagaaatttaagcctcaggccaaacctgggaaattcaagcctcaacctcaacctaagaccaattaagtaaattatttatatcattggctaaagtataagggagctaacctagtttaaggccatccagtgaaagatcaaatgctaaatgagattatttactgattaccaaaaaactatcatgttaattcagtaaagatctcataatcaaatacattatcaatggtacttctggaaaactgcctttggtgatcacagatattaacctgaacccaaatataccctaagtaacgtactaacaacctacttcataccagtcttattttttccatctctactgctcccaccttaatctaggtcaccatgactctccccaggcctactgaaatatctgccctcaacctggcctccttgcttctactctagccccttctccaaactgtacccctacaaggcccccaaagggatctccttcaagcacacatcatatcataccactctcttgtttgaaactctttcatacgttttaactggtcttagaataaaactggaactctatcatggcttgctgtgccctgccagtcccaacctatcctagtaccaacctctccattcccttcactccagcccaactaatctcctttgtatcccttaaatatcccgagctcttcccatcagggcctgtgaacttgctgttccctctgtccaaaatgctcccttccagctttgtacacagttgactgctcttcacccttcaggtcttagctcatccatcacctccccgagttaccttcttgccctgtttatttccttcatagcacttataaagcctggtaattttgttattgtttgaagactgggacacactatgaggacatgaagtttccctattcttttttactacctgtgtcaggcatcatctccttggagatgaaaggatggataaacagatggatggatggatggatggatggatggatggatggatggatggtgggtgggtggatggatggaataaacatgcagtagatactttctgaattatttgacccaacaactggaaccatccatgagaaaccgtattatcacatttagcaatgagtgattctggcagggatgtatatagggcaatcccagtttctcctgaagtacatctctcctgggaatataaagaagctttaactctgggaccattcatatggctctttccacatggtgagttctactcttaaaggaaaaatactcaattatgcaaaattgataattccaagaggatagcccagtatttaattagctataatatttggaggcataaggctatcctggtttttaattttaagacatccaatttatgaagaagctctttcagagaaaataaagtcaactcaacgcagaataagaccacaagctcaaaaaaaaaaaaaaaaaaaaaaagaccacaagttgcttccttagattcctatatctggaactattcctctagaggagatagagcaaatcaaacctctgacaatgtggaaatccagcatgcacttcatttttgtttatgacactgggtcaatctgacagaatagttttgttttcccagttctgactgaattaaagagagttgtgtctacagattattttcccagaagttcctctgtatatataataggaaatgcaggatcagatctaggcaagggctctttaaatgtcagggcagtctttccacattgaacacccctgagaatgccaacatgtgtgaccatgcttttccccattttgggccatgatgaagaaatgctatcccaagccagcagagcagctgaactcttttctgtagctcaacatgagaaaaaccaacaacctctgcagcatgtctgccaaggaactgcatgcctgttggcaaggagacagcagcctacacagagggaagttgtaagaattagcccttccatgcatgtgctagtggtaactcctgtaaagaagttactagggtcttcgctcaggacatctcacggtgctccctccttgaaggcccacaggagaaattcctcccagaactcagtaccaagagaagctttccttctcctgaagacttagttttgttgttgcttcatttggccttttggatgctataaatactttaacagattatattatctctttgcttgtaggaagccctgagatttgcaaccctctacactatcgacattggacattatggcatgcattcttaacatttgaactgtgccccgacttcatcttgcttttttactgttgttttccctcaattctgatttcgttaactaatctttgttctcttgtatcatatatatttctataaatggtttcaaattattttgagaatgaaaatggctattaatgcataaatacacacagtggattttaacccaaaccctttacgacactagtcctgtaaaaagacaatgtggcctcagacagacctgggctggaatcctgattctgtggatttctagctctgtgacgttggttaagtcgctcaatagttcccagtttccatttcctcctctttaaactgaggctagtatcatgtacattgcatagtaactgtgagaattaaagagaatgtatctagagcattggcacttaataattgttaaattaaacttattctttattattattaatagctatacagattgttaccaaagaatacttaaagacaatgtctggcttatcatgttgacaggcttatgagcactaacactatctactcatataccacatttctctctaacaaagacctacagttaaacacttccatactagctcaatgtctccaagccattctttccaacatgctagatttgttgcaagatcctctccccattaaggctccctgtaccatatcccctgtcgtggattgaactgtgtctcccccaaaaatatactgaagttctaatccccaatacctataatgtggccttatttggaaacaaaagactttgcaaatgtaatcaaattaagaagatgtcatactggattagggtaggtactaagtgtaacaagtagtgtgctgataagaaggccattgaagggccacgtgaagggacacacagatgcatgaaaaatgtcatgtaactatggaggcagagatgatgcatctagaaaccaaagaacactaagtactaccagcaagtaccagaagctaaaagaggcaaggaaggattcttgtttagaggctttggcagaagcattatcatgatggcactctgattttggacttccagactctaggactatgagagaataaatttccattgttctaagccacctaagttatggtgatttgttatggcaaccctaggaaatgaatacatcccaaaactcctacagccccaagtggcagaagtaaagaaaccaggcaaacttgcagtccaagtgatgactgccaagaactccacacatacatgcctggcagtaagatgtatttcatgggaggcatatactaaaatagcccaaagagtttgaccatactcttcaatgaattaattcttctttctgagcttaaaagaatcacatcaacaggagggcattaggcctagatcaacaatggcaaatagagcttaactgagaatagctggattacagtgttatgttcaaaattctgtggagtcatctgggcaaagatgcagagacaaaacaaacaaacaaacaaaacgaaaaaaacagaaaaaactaattatccttatgcctgtgaccatcctctccagtttcctcttctgctgcccactgtaacatagcatattcttagggttctgacacagacccacttcattccattccccatatattctctttggacagacccactgattcttatagtcttaccacttacagcttctgtggataccttccaatctatctctcctggcagcatcagtcttctgctcttgtctaggcccatatatccaactgctggatagacatctccacttagctatctcagacaattcaaagcaacttgtctataacagaactcaccagttgctcccctaagcctgctcctcctcccacaggctatctctcagctggtggcacgatcatatacctagctagaaaactgagtttctccctagtctatttcctccttctcacccccgcctcccattccaaatcaatttccaaaagttgccaaccttaacttctaagtaattgtcttcttcttgatacctgctatcactctcctaattcaaactctcatcaactcttgccttttaagattaagactgggtatcactgcctccaggaacctctgcaagggactgtatttgtcttgttttcccttgtattcttggaatttggcattgtgtctaacactgtaggcaacagatgatgatgataactatcatttattgtccacattctatatttacacagttatacaattctatcaagaggtagaattggctgggtgtggtggctcacacctgtaattccagcactttgggaggccgaggtagattacctgagatcaggagtttgagaccagcctggccaacatggtgaaacccagtctctactaaaaatacaaaaattagccgggcgtagtggcacatgcctgtaatcccagctactcaggaggctgaggcaggagaattgcttgagcccgggagacggaggttgcagtgagcagagatcatgccactgcactccagcctggccgacagagcgagactctgtctcaaaaaaaaaaaaaaaaaaaaaaaaagaggtagaattactgaactgatctgatattcaatttagattaaaatatactcataagataaaatactgaaatgcatatctgttcattcaataaatatttattgagtgtacgctgtgtgctaaacaccggggataaaatggaaaacaaagaaaacaaacaagtaagtgagtatataaataacttaatttcagacatgggaaaaagtctagcatctctcaggaaacccattccaagcttcttctcaggctacctgcggggagggatgttggcaggaagaaaagagacccctccccacttagtccacccccttgctctagaagattattcctagataccacccccaacctcaggcattgttcagacacttaagaaatccttaaatttgcagcatgtgaatcctctgccaggctaagtaaggccaacttaaatttttctatcataatacctttctttgttcttcagaaatgtcaagaaaccttatgaccacatgcaagctgatggtaattaaaagaagacactgtcttcatctccacaacgccaactccttttaaaatgtttacccaagacaagaggacatttctgtccatcacccactgcacgctcatcatttcttcccaattacagccactcttggatgtgatctaggaaaaaaatccacatctattcactgagtaaagagaaggattattctggtaggtgacatccatttttcatgcctgccatctgaaattcttactaacatcctcagaagtaaaagccccattcgggctcaaaaggacccagggaaatcaacactgaaatgaggatatggatggaggctgttctggtcatcctaaaacagagagtaggttttactgatggtacacgtttatttactgagatacttattccatcatgctacatttctttttatcagggattcttttccaacagctcaaattatttctgggtgggaagttactacgtgcataatcttcagttgggctggaaaagacaactggatattagtttgtccaaagagcccctctaaggttgataaaattaaatgacagctacagggagcatcatgtacaaaaaagcagcaaaagggggtggtggagaggaatggtcttagaacttctcagcagttttgcctatacaggttattactgaatcagatttgagaactataagaagtcacacggcagtttttgattaaactaacatttactgtgtaagaagtgccacagatacaaaactaagaaagacacatttttcttctggaggggaagacatatgaatcaaccaagaaatacaaaactgtgtgacatcactagagtagaggtacgaaagtgctcatgatctgaccagcctcggggaatcccaaggagaatgcaccagaagtagtataggacattaaatggacacctaagttgccatctaccactctgttaattcccttaattttccccgacatctgactttgtcctctccatatccctacacaaaaagaaccaaaccaccaaataactttactgtcattaagacatggcttcattatcatcattcagtcacccaacaaataattattgagcacctactatgggccaggtgctgtgatagcctggctctctcacaggcgaggtctggtgagccatttatcctggacctcatatccataaagggctgataatatagatttttaatatcatctccaaatgatatcctatatacagtcacacagataaacttctaggattcaacctcaaagcatatcacaatttttataatcctgtattgccaattttaaaaatatacacccaagtcctcctactgccacccatggatatgatccaggtctctcctattccctatgagcatttaagagaaagcaaacaagccagttgttataccttccctcacagaacttattgcttagtagagagaaaggtatcaaacaggacacataccaaactgataactgtagttgccgcaggggaggagaggagcatgacatgaggctgagctgttaagcaaagctttcgcttgccctgaagtgtttgaatttttaccatatgcacatatccacagtattccctgaatagtcattatcagtttctctatcagggtcatcattaagagaagagccaagaaagggaccagaagacaagctggccccaaatgaggctgaccccaatgctgaggcagtgagaatgagtgaaacatctagttgccagaggtgactgcgtttgtctgaggataaaatagctgcacacaaccttgtgatgaccatcctctgcatgccccatgggaagtaccgctaggcctggacacaaggcttccttttcctgggctctctactgggctcaatcgcctaatgaccctacaaatggaacaatgtactttcaagaattgagtaatatggatgatcaatgtgttactctcgtcctgattcgaaacttgtcttttcatggagagcaataaatcttatcagtagatgccaaatgcccctcagctgaatcacagctatatcgtctagactgaaatgtctcatctccattttgccaaattctgccttgtccattacagttaatctcataatccacatagacaccacacaattccataaacaacagagcagcccctgctaaccagccctccctctgaggaaagcctgaacatgtataaacgatctcaagccatgccagggaaataagaacagatatcatggaaaccatgttagcatgtcagtgcatagcctactgatgacaaactcagcagttatgccagacgaatttaggagtcaaaatgtttccttacactgtcattgttttcaattttctgattatatttttgagatacattcaatacctctggctttacagaacagaggtatgaccagtgactgatcattcaataatgcttctaatcagagtgattatatgtgagtgtacaagtgtgtgtatgtttgtgtgtgtcagtattattttgttttagtatgacaggtgacctctttgccatgtacacttgttacgggtatgtgcacatgtaaagccagcatagagaaatgcaatcaaatgtaactctgcaggaggaggaagagtagcagaggaatggctctctgcaggggatgtcacgtctgagctctgctgtgagaggtcagtgggagcttgcatggtggatagggttgtcagataaaataaagacacccagttaaatctgaatttcagaaaaacaatgaatgactttttagtaggtatgtcccaaatattgcatgagtgttctatatttttatctgctaagacaggcaatcctaatggtgggagaaggacagatgtgtatgccaaccatctttccttctttgtcatgaatattgtcaatatcagcatctattaacgtttacagaacatggggaatggagtccttgctcttggggaaccctaagaattactcctcctgcctaaaacactcagaacatgcctgcttcttcaaccacagcctcctcgagatcatgcactacaacttattcctccttcttcaggacctaggccagtgacggaaatgtcataaacacaaaagtacatttttagataaatgagaatataatatggaattatagtaaagggaggaaatttggggtgagagggctaaagatgacaaaactgtgcatggctgaaaatacaggcaacttcaagacgaatgacaatagccaaatgtgcagccatctccaacacctatgagcagaactgaacaatcttttagcttggttagtatcattgaactgtctcaaactagtgaaaagtatactaagcaccacgggcaatttcagggaagaggggaatgcactaaattgggagaccaacacttatacaattatctgttttttaaaacccatggttaaggaggccaaggcatcgtaaaagcaaaatggggaacaagcagttctaattggaacagttcaagaagttttaggtagagaagttatatgaggtatgtaaaaagccatggccctcagagaggctttgcactttatagaatgtgtgtgtgtgtgtgtgtgtaattataagtatatatacatgtataaacatggctgcaagaatagtatattcccacatactgtgtgttattcatatcaactgattggaactgagccttagggagaatccacattttctttcaaaatactctagagtagaaatgtttaaacaaataaaatagtattgatcccatttcagatgtataataatttttccttttttaatgtatcttcttttaaaaacagccttctcttattaaataagaaatacttggccaggtacagtggctcacgcctgtaatcccagcactttgggaggccgaggcggtcggatcatgaggtcaggagatcgagaccgtcgtcgccaacatggtgaaaccctgtctctactaaaatacaaaaaaattaacgagacatggtgacgcgtgcctgtaatcccagctacttgtgaggctgaggcaggagaatcgcttgaacccgggaggcggaggttgcagtgagccgagatcgcgccactgcactccagcctggagacagagcaagaccccgtctcacaaaaaaaaaaaaaaaaaaaaaaaagaaaagaaagaaagaaagaaaaagaaatacttgctcaccacagaaaacttaaaaaatccaggtaaataaaaatataaaaataaaaaccacccattattcttccagttagagatagtgactcaaaatttttgcatatatatcaagacattttttcatatatatatatatatatatatatatgcatatgtctatatttaacaaaagtggtatcagcctctatatgcaaatataagcttgttttttaaactacaaagtgtatctatccaagtgaccaaatatattcccacacataatttttagtgcttacatatatgttttctactgatggcttacttaactaagtatttattgctgaacattaaaattgttttccattttttgctgtgacaaacttccttacagctaagtctttaagggcatcatcattatttctggggaatcagttcctagaggatcaatcgctgagtcaaatattatgtacatttttaaggcttttgatccatatcaccactttcctctctaggaaggttgtgtcaatttataacgctatataaaagggcttgttttcttaatgttttccaaatttggtcagcccaagaaatctgcccatgaaataagaatttatgtagatggaacaaatagaataatatatatatatatatttttttccgtaagaaacctttcctaaaagccaggattttaagaaatcccacttacccacaattagcctttggtgcagtcaactgatttagacaagaactttttaagccaacttttcaatcaaagtctgccatgtttgtggaactgtggctatttaccattttacaatgacttaattgcaaattaatgtatatcttttttttcttgagaagatataataagctacctttttaaaatgacaatccattttattttcctggagaaaagaatccatttgctttaaccataatcagaggaaggttatttggtcaaacaaagtaaaaaccataaacaatagatagccatcattaccacagtaacattggtccagctaggaattcacttagctaaatgggtgacttcctactcacatacctcctcagtgcacaacaaacacaggagcaaacaaaagcctttacagaatccagaaccaccaggcaagaagatataataatcaagcaatcaagcaaaagtttaaaaatactgcctaaactgcaccaaaaaaaaaaaagaaaagaaaagaaaagaaaatgatactacaagagagaagttaatgaggcagaaagatattctcaaatataaaaccccctccaggacttttaagaaaggtatcagaggcatatggaaggctaagtccaggatggatttaactgaagaaaaggatatttagagattatcaacattttctaatgcaacagaaaaccaagccaacttagtctcctacttagtaagtgccagctctattcttcatctttttggagatccagaaaaatcaaaaagagaaaatatccaaatatagaagcttaatttaacaaaattggaaaaacctaaactatactgtgctctggtgacctagcaatcaaataatcacagtcatttggtcaatgtctatgattaactcaatgagacaggatgtttggctatagcaccaggtacaaaaaatatattttcatgaaggatcactccctcttatgtaatagatttgggtgagtgagtgagtgagtgagtgcatggactcacagcttttggctttctgaaataccctgcatcagtcttgttatgatgattccttagtgctgggatggatcatccaggcatttaaggtaacacgatggtaattctttgctcatttttcagggaaaaaaaaaagttatcacttccaaagtcggcatagtcacccgaagtaaaaaaaaaaaaaaaaaaaaagcctcagaggcaaaggaaaggggccgcaaccttggttaactgtgaaatgacgaatgagaaaactcctcctgctgaagatattcaggtatataaaggcacatgaaggaaaactcaaaacatcattgtcatatacacatcttctggattttttagcttgcaaaaaaaatgagcaccaaacctgatatgattcaaaagtgtttgtggcttgagatccttatgggtatattcattgctggcaccctatccctggactgtaacttactgaacgttcacctgagaagagtcacctggcaaaatctgagacatctgagtagtatgagcaattcatttcctgtagaatgtctacgagaaaacatagcttttgagttgccccaagagtttctgcaatacacccaacctatgaagagggacatcaagaaggccttctatgaaatgtccctacaggccttcaacatcttcagccaacacaccttcaaatattggaaagagagacacctcaaacaaatccaaataggacttgatcagcaagcagagtacctgaaccaatgcttggaggaagacaagaatgaaaatgaagacatgaaagaaatgaaagagaatgagatgaaaccctcagaagccagggtcccccagctgagcagcctggaactgaggagatatttccacaggatagacaatttcctgaaagaaaagaaatacagtgactgtgcctgggagattgtccgagtggaaatcagaagatgtttgtattacttttacaaatttacagctctattcaggaggaaataaggtatatttttggaattaaaattccttttccctccgaaatctctttctccttctcctcctccaacttctttttaaggattgttgtgctgtcctgtaagcctgtcctcagttggactggtagcctcggaacatcagggacactcacctctctaaggagaggtaatgccaaccatcctcagggtgaccaagagtctccttagaaagtctttaagacatttttaaaggaataagattccctctccgtcttcttctattctctcttgctcttttctgtggccattttgaaagagctttgctatatataccacctgtggacttcaccaagacaatggctagaggatagggagcagagaatgttgcaaaatggtaacatttcaatgacttaactgttttgctgccaaggttgcttatcctatgaaaattcagcacattaaaagagcttatacatgctccctagagtcaatactcttgcattttccccctcctgctcggggggaaaaaggttgacatttctggcccatttccttctcagcttggtttgtttgaattgatgcttgtggaatagtatttcattactttaagagtgaagatccatagtgaaattggatggatggttgaattagacgaccattaagctttcatttaacctttgagagtctgtgattctaatgtagcacactcttcattcctgatgtatattgtttgattcctacatctaaaggcatggaaaatgctgtggaaaagtatggtacagaatctgtcttttactgtttttcatgtgcctgaaataaaatgtccagagtcataatatggaacaattttacattagattttcctagttagaagactacattctgtgagttaatttaactagctattccaataatacataatactttaatatcttttatctttttaaaagttactttgcagccagactacctagattatttacttttctagcacggcccttcatctatattaattcaccacctagctgacatggattttctcttcctctcgcacctctatctaccccatttcagaatcatctaccttcaagcaagaattaacagagattgtggctacgcaaatgcaccaaaaaagggtgaaatatatctgaaatgtacctggttctgcccttggaagccatttcctgctcatgccactaacagcatgctgccaaactgttcagattcaagattattccaagcgcagggcccaaatgttatagccaaagaaagtcttatgataaaagtgaggcaaatttcagccaagaagttagaagagatgtttaaaagaacaagaacaaattgtggatcatggtatatgcaggctatcagcagaaggatcagacaataaaatgagttagtgcaaaccatttagtaaaaataactatcagcagagttgttccagattaaaaatagtactacaagcttgtaaaggagttaggacatgcaagctactgagcataaaatatatacttgctatttttcatgactttctctaataaagtctttgcctgttctctctaataactttactggaatgaggtcaattactttagtcatttatggttgcagtcctgccaagtgtttgctatcctggaggaaagagaatggctgagaaagccgagctgagctttcagttaatatacattttctgaatgtgtggcaggggtagaagtcagaacagtatgcttttttaaagatcacatctaatcaaaagaaaaaggataacatctccactggaaaaaaggcaagggcacaaactgacatcatcacaaaggaagaaatactacagacaatgtgaaaaatgtttaatctaacttgatttttaaatgcaaaataagatgacaagatactcccatcagtatgacagaaaagaaaaagaatgacaatataaaatgtgagtggagtgtaaggtataggagcctttgtgcattactgggaggaaagtaaactgggacatgttttctacagggaaatatggcaatcttcaatatcctaaagaacgcatcagcccctgtgacctaggtatcacgtcttccgaaatttattccaaggaaataggtttatgatatctcccccttttacattcattttcaccattcgatattttctattttttcctatagtgatttttttgggaagatttttaattctaaaagaaactgtacaagcttaacttccactataattaccctgttttccttagcggggtaggccaagacaagaaatgctcttttattttgttaatgatgcctttgggtacttcttgagtaactttggtcttttttgttgcttctgggttgctgctgctaaatttcaaaggaatccttccttggggatcattttcataatgaaatgtttgtaaagtgccttgcagtacttcaaagatgttgcttttttttcttttcctggttccaccgttgggaaggtaaagagatataatacccagaaatcactagagaaagtgctctatgtgtcgcattcctggcttagcagtctcacttcttttatgttaaatggaaactcaaaagttctgttgagttcgcaaagggaaaactctcagagctgtgcagagccaagcttctggtatccactgacaatgtctgagtgggtacatagatcataatgttcctacagaagcctctttcttcccctgggttgaggaggaatcaaaagtgtaattgagcttccttggaagagggactcattggggatcccacaggaaaagctggcaacagcaagtcaactgcaaggctatggggtagcataggttctaacaggtgcacagtctcagtcagcctcccctcagaggcaagacaactcgctgggcaccatctggggaccctgacttctcagagtagctactttgcttttgccccagttctttaatcaataatccacactaagaatgaacacaatgtgtaagcatctgacttgtgcagggaaacagggccgcctgcaacccaacaagcgcacccacaggggaactcgggaccatcctaagccacttgttctctgggacgtggaagcaggaactgtgctctagccgtatctgtgttgcgtcgtctgagtcctctttttctacaatgaagaaaggggacttgggatttaaacttggagcggtactcaaagccagaactccacgttcattccggagtgaaccaccacactactatttccaggcaacgtcataaggcttcctcgttatttgcatcttcgttctctttttggcgactagcctgccctcccgcccttggaaacttgtggaccccagaatctcagctttccgcctaccaaaggtgccccgatcccctcccactgccctagcagcggcccagccccaacgcctttggctagagattgaaatcctctggaaccaaccactggacgctctggattggggcggaacgcgcttccactgtctcgaaagcagcaccttctcggatttgagcctttgcggcgcgcctgggctgagatctgagaaatgcgccctgggccacaggcagcagcggaggcggggaaggaacaactttccctccgccctctaaccacaagggcggggtggggcggcctcgctggggtcgggctcctccactttcccagctgggatcccctgccggagctggcgtgggggccggggagggggaccagaggggcttccttctctccccaagccccgccagatgttggaaaggcaaacaataggggaaacgcggagaaacaaaaggccattcgccacgatctcagtcggctgcgtagagagatctctgtggggagggttaggggagagggtcaggaaagagcgcgaggggggggatcccgagagatttagagtctctggtacttgccaggcaccaggggtcggcgctttaccctcccagcaggggtctgaaggtgggaaggggcaatcaaagaaaacttgaagggttttcaccttcttccccagttcagggaaagggaggggctgggattccagatgtttgacagttgttggccccaaagttaagcgcgatttgtacggcctttacacgctccccacctccgtgaggcatcgtcagccccgggggcgacctggctgacggtgcggacttcccctacgctgccccaagccgagactcctccctcaggatcaggacgcccaagcgttgtcccccagcccaggcgcacttttgtaaaagtttgtcttcccgccacccacagcccaacacgcaccctgcaggcgtccgcggctggggatgggctcggagtcttgcaccccgaaagaaggacgatcttattgatttatatcttttcaaatcaaggacaaatcaagatcccggggtggaaagtgggcgacccttgttcctgccgggaagtgcacacgaggagccggccagaaacccaggcgccggcaggggtctgaagaggactccagccccggaagcccgtggccggcgggcagaagaccggtccgccgcctcccgcaccttcttgcacccgcgcccaggtgcgccccaaacctcgccgcccgcccgggcgagatcgggagcgagcagccaccgggctgcgccgcctcccctagcttggagcgggttcttactcaccgtggggttttacctccagcccagggcccggtcggctcccttcgccgggtcagctgcagccagcgcgaaagaaaatggtgagctcggggcaggtggggcgtcgcttgccaatccacgcaagggactctgccgccggtgcgcgaggtcccggcgagccaaccggcggacgggcgagcgcctggctccagctgcagccgccgtcgctccggagcagccccctcatgcacccagcgcgccgcgcagccggccggggctcgactgtctcgcggggacgccgagcggggacccctggcggccg

SEQ ID NO: 791 - DNA, 742129 bp, Homo sapiens
gagccgcgagcggcggccgcggggccgaggagcctgggccgggccgggcggggactactccggagtcaggaggcagcagcggcggaggacgaggatctctggcagtcagcgccgctcggacgccgccggcaccatgggctgctgcaccggacgctgctcgctcatctgcctctgcgcgctgcagttggtgagtgccccgagggcccctgccccaggacaggtccctgctccaggaccggcctctgcgactccctctgcggttccgcagctcccggcaaggggcgaacgggtgaacagggcgctccgcccgcctcccaccctccccaccgcctggctgggctcgcactgctctccagccgcgggcactcgccaggtcgcccctgccctgcaggagggcgcggtctcacccccggtcccatgcgctggggttcgccgcgctcccgccgggcgtcgccacgcggtccaggggccaggagccggcggagtgagggattttcccgccccttgatccgatacctggtttagcaccctccgcgttcgtgctgaagttacacggggacttgcgggctctttcttcttaggatgatttccaggaatgttgcttaattacactgtgtgggaatgcccaggttctgaggagacagaagctgcctcaactctgttagtgaagagtgaggtggttctaaccttaagcaggttgaaaagtgatggttaaggagtctgggacctccaggaaggagatcaggctgtgtgcttcagcccctgcccttccagttccgctttggattttgttgaaatgttgcatgttcaggcggcgacagactgacagctgtcatcaaggagagaacagagtgaaccggctccattggcgcggtgccttgcagagggagtgtgtgtaatgggaagttagaaactagagtggggaaaaaaggccctttcagagcagagcaaatgctcctcttaatccctttggatcctggactggctctgtggtctattccatggtcacttgaggtcaaggccacagaccttttgagtcagacttttgtgtgtgagagattaatagacatctcccttgcgttatacttcagacagattctgagtgctctgccaagctttcttccaagcattgtattttttttcgagtcacaaatataaactagtatattttgacaagtgagaggaaaaagcttgcaatgaactttacttagtaatgtcatcccttgcaagacttattaactgagggataaaatcgtgctttttagtagttagtccttgtttacatgaaggctttagaatgttttcacttttctcttgcctcagtgttccagtctcccatgaaaacctcactttggatgtgcccttcattgttcacataatgcatgcataatttatgtattcgtaggtttgaaatcagtgactttttaagcctattggatagtgccttctgtcttgtgaaatacttgaatcaaacatattttatagtttcttgaaaaaaattttaaaaatttaaaacaatatgaatgttttctttcactaagaaaagaaggcaggagcttgatttgtattttggttttcagaaatggacatggcttataagttggaaaaactgactaaacattgagtcaacccttgattcaatgtaagattatagataggcatgctggattgcataatctataatgcctaatttctattttacatggaaataacaagtaaggtttttatgtagcagatttatcaatgcaattatgattttcttaacaggcattgtgatgataatgtttttgagatttcatccatcagccaagcatgccccttctttccactttcttagttgatacaaatgcaacttatttgtcaaagcttatcttaaaattccattttttaatgaagtcttccttggtgctccaggtaaaatcccttatattcctataatctcatagcacttcgctttttcctctgttataaaacatttgatacactcttaaataattttaagttatttacacatatttctcaccactagattgtaagcaacttgagggtagggaccatagtactagtgatctttacaaactctgcaagttcttagagctcatattaggagctgaaacatatttgctgaatttttgataatacataacatttgcaatccatacaggactttgacataaacatttcttttgacttttaaaactatcctgtgaggtagatactcatttcatttgtttgcaggtgaggaagttgatattcataaacagtttttccataatcaagagtttttggatggtagaaatattggggtgatggtaagcatttaacaactggattgtaaacaaaacaaatgtatatattacattataatagcatacaagataatcttctctatgtaaaagatgtgtagctctctgttgacaaatgatagcaatagtaaaatatgtaatagtctttagtgtgaattccatacagccattcaattttggcagaatctttttgctgagtttgaaaaactcttggttttataaatctgacatgaatgctggtgaatatttttgtatgctttaagaaaaaagaggaaagtgaaaatttgaagaaaatattcgaactttacttcatcaattacatgaaaagattcttggctgaattggataatagtttttaaatacttaaaaattatttcctcagtttctttcatagctattgacaatgtaatgtctatagacatgacacacttttaggtttaatatgcattatttaaaatatttctccattatttaaaaagcctagacaatcaacaaaacagtaagcaaccgctgatttgtggggtttgccaaattctttggtgtaaatactcccatcacgaccaatttcaagtatactttatatagcatttccgtcatatacataagataggcctaacctcaaaagcattggtaaagtaaaacacagcaaaataattaggaaggaataactgttaactattcagtaccttggtttttagtaggatttctttaaatttaagtttgcataatttaatttttaataatggctgtatttaacaactggctcacaaaattcctaaaaatctaacaaaaccaattctaactctgagcccgtataagcctgcttcagcatatcataggatagggatccctgtttcctagatctggtgcactttctactgaaaccaactgttttttttttgctcttttatgtttttttctgcttccaccaactgtcagacaatggagattatgaggcagtgaactagtgagggtgttgaaaggggatggcgttgggagaacacatctgctgaagacaatctacatgctcatgactaaggcttaactgggaggtcatcacatagatgatacattagttcctcctaaaagttaaagaaacaaataaaagcttttcgttatcttattcccattttgtctgaactactgtctggagtgggaaaataaaaactcaaattgggaaatttacttggagaaaacatatccttttcaagctagtatctgtggatgagtttcggtttgcaaaatctcagtcattttctacttttttcactccactgctctggctgtctttcatcattagtttttctccaggcttctgccctcaagatgtttgcctcatggttttcatttgtgatcctcctgattttcctagatgaaattaaagagaaagtgaaaagtatgaatacaggcccatcaaaaacgatgtgaaataattttttttaaagaagtgattcattactgtgtcactgattcatctagtcatccaagagcctttagtacattttttttgtaaggatactttcagttttgcttgttttataatactgtatatacttatcattagatatgtgtaatttatacataaaaagaagcacttgatcatgtgcttttagcacattcttttcaggtaccacatttaaataaaccttaattgcatggtttcaaagtctgacatgccacatctcatttcagagccattttctgagagtagcctcagtgaagcactgaactaattttggcaggcattgttcccacagagctttagacatcttcccaacctcacagaggtcggactctggcaagttcaatgtaactttggcatgttcaacacatcttcgtctcaggatgttattattacccatggacattcattgcacctttcatcacttcaaggtgaaattcttattactattagacctaggaataagggaaacaaaactcaaaactctcaccagacatatctgtggtaccagaaaccctacaagatttagagaaaataggcagcttctaactcatagatgtatattttttattgtagagaacatctgactgggtacagtggcttatgcctgtaatcctagcactttgggaagccaaggtaggaggattgcttgagtccaggagttccagatcagtctgggcaacatagcgaaacctcatctctacaaaaaattttagccaggtgtggtgagttgtgcctctagccccagctacttgggaagctgaggtgggaggattgcttgagcccaggagatcaagactgcagtgtactatgatgccaccactcactccaacatgggagacagagtgacactctctatctaaaaagaaagaaatacataagtaaataaataaataaatagagaacattctctcaaagaaaatcagcattttttctcacagtggaaacgaagtttagttaacttcctttccataccacattcaaaccatctgtgagcaaagcacctatgacactagaatgctgagataaatgtgttaagaggtgtctgtaggggggtggtgtagctgtggtaacatgtttttaactaagctctatgaaaggtgcagctcacctgtcgtagatattggacagcgaatgctgaaatatatttcttttactatgtatttatactgatactttggctttgacatggttttaatagttcttttcttctcctctgcactataattattaatcattttgtttccattctctttctttatttcaataccgtggttcatgctatgaaacttaaagttagtgaaacttaaaggttagtgaaattcaaattttgtctactaatgagacttgagttatactgtgactggtattgaaaccattctgcgttggcaaatactgaagggttacatcgtgagtaacaaaatgaattgttgtgcttgggtatcgtgtgtgtgtgtgtgtgtgtgtgtgtgtgtgtgtgtgtgtgtgtgtgtaggtctagcagatgtgtttggatacataagggttctgttttagatactttaagattctgagacttgaggccaagtagctgtcaggtacatgagtgtggaacctagagggcaagcctggattgcatatttagaattaagaatcatgaacaatattggtatttaaaaagccctggatgagatcaccttgggagagagagtacatagttgagactagaaccgaaaataggacttaatacaaggtgagtagagaacaaggagccagcaaaggatacagaagaagaggttggaaagaatcaacttactttaaaaatagggctgacatttcaagataaaagtaaaacaaaacacaaaaaacatagagctggaatcattggtaataaaaaggatatatgccaataaataattattatcaaattatatcttttgatttttttttctgagaggttaagagcaaaactatcattttaataaaaatacatgaattgtcatacttttgtattctgtcctaggaagccaggtctgtggaagcaaagtcaacataagcagtgatttccgtggcatgtaaatcatggtacagcaagagagtcattttatttaataagaattaattaacaaataattttattaaatgtttagtaaagtactaagcagtcatttaaattagcgttaacattaatacagtcaacatggattagttgtaataaatgacatagacccttcagttaacagagcattttgtttttatgaacaattgagtaaatagcagaacactctgacagcaaactgctgagaagagtgttatgggaagaatttcgtcctctaaaaagatacattgaagtcctaactccccatacctcagaatgtgattttatttggaaatgtggtttttatagaggttattaagctaaaatgaagccattaatttcttatgactgatggcattaaaaccaggaaatttgacacaaagacagaaaagcacagaggaaagacactgggaagacacagagagataaaaatcactcattaaaaataaaaataaaaatcagaatggaaaacacgcaattgggacgctttggggaaaagatgacagacaagatgttactgagctagagagacagtagaccttcccttttttccaaggtgccacatgaagactgaggattggagtgagccagggattgctggcaaacccatggaagccagggagaggcaaggagggagtcccctacaggcttcagagggagtaggcccagctgacacctggattttggatttctagcctccagaactatgagataagttgctcctcttgttttaagccacttggttgtgatacaaggaaaccctaggaacttaatacagaaagagagctagtctggagtatgttttaaggtagaacaaacctaggtttaattaaaaccacttaaatggtgaaagaaatgcttatgttcaatgtgcatgtggatttggacttacgggtggcagaaggttgagaccatgtcatggcaggaataattagagtcaaagggttaagttctcaggccagcagaggcaataggccaggcctgaggactcctggacagtgctgccctcatgggagtctttggatcagcagtatcagaatcacccgggggagcttctgaacaacagtggctcaggctcaccaggatctattggatagaaatattttggagaagggctcaagagtctcaaattattgaaagctccttgcatgattctgaggtagatcgaggtttgggaacgtttactcaaatgaagagttccctgggtcagaagaacttgaagaggaaagactgtggatacttcctaaggctattaggagcaaacccagtttctgaaggtcagttgagagccgagttagctgagttgccactctaaatgtccttagtttttaagattttaggacggatactgggtgtggtgcctcatgcctgtaatccagcactgtgggagactgaggggggaggatcacttgaggccaggagtttgggacctgcctgggcaacaaagtgagaccctgtctctataaaaaaaaaatttaaaaaaaaataaccaaacagtaagatgaatacttgtagtcctgcctccttggagattgaggtgggaggattgcttgaactcaggaggtgaaggctgcaatgagctatgatcatgccactgcattccagcgtgggtgacagaacaagaatctgtctctaaataaataaacaaacaaacaaataagtaaataaagttttagaagagttgcttctcttatggaaacttaatgtctatgatagcatggaatcatcctaacaggctcttcaagggctgtggtctgttatcagagggagtgtcgtgtttcccatcctgaataggtcagtcactgagactgcctgtcctctgcacatgtagcatctggtgtatctgcggtaggctgtctgctcttttaggtcgtaggctgggtcaggttcagagcctggtctggagagggagtccagatagaagccccaggaggaagtgggtgaagtgctccctcacagcccctcttgacattgcatctatttctttagtccaggacagtaaagatcactttgcttttataaaagtgcctcagggctcatactgcatggtttcaaggtttacttgaagtaaatggtttcaacattccttctagaggacacactaaaatggttttagaccatatttgtgaggctgacgaatgttcctgtttctctactttacaaaccaaatttcttatttttatttttaattggcaaataataatagtatatacttatgaggtaatttgatgttttgatatatgcataaaatgtggaataaaaaaacaagctaattaacacattcatcacctcacgtatcatttttttgtggcaagacatttgaaatttactcccttggcaattttgaaatatacaatacagtattattaactatagtcactatgctgtgtaatagatctcaaactagagtccttatgtttgtaaccctgatcagcattggtttgaatatgtccttctaataagtattcataagaaagttctgcaattctcatgacttaagcctccctgacatataactatgaaatttataacatccatcagaccttttctctcttaagcttcagttacttatttcaccttttgttttattaactaatacttcatattctttacgctgaaacctaatttgtttttaattctttaggttgaaacctcctttcccaaattccccctttagcttgcttgccctgccaagagatgtattgaattcattttctacaatgcctgattaatcttccttaagtggaaacttcatcctgtcactcctcttcaaaaaaaataatgtctctgtaagctgccatttaatgccttaccaaaatagaattatttcctacttctccaggtctgcatcctcagttccatagggacagatttctatttcatgaacaacacatattcatacccttgaacatatgtagttcaggcttcttgaagcaaatttcaaggttgtaaaactaagaaaatggagatgaacaaaattcactgaaatagaaagaagtatttatatatacctgtagttattattctttataaaataatgaattgcttttgtttttttcaaattatattctccattttaatcaaatcattttcattccggttacttacatatagatttttgttttgcctagtcctttattttccttaggagaataatctatatcataagattttgggaaataaattgttttctatccccagaacatcaatagtctttgcttttaaaacatgaactacttattttattttattttattttatttttttacctttctctcacaaattgtacctgtgttgtagcaatgtatgttttcagtctctaggattggaacagttatccagattatataagaaaggaatttcaaatattgtatgcttaaaaaatgagccaatagtacttaatattttggcattaggacaagatacacattaataaaaacattgcatggtttctttgcagaagttttgatgagtgatcaggaaaatgaacaaatctacatgtgcatacttgaactatttccttaggcatttgttttcatcaggtgaagatgaaatgcctcttgcttaaagaatcagattggctgggcatagtgtctcagacctgtaatccccaaactttgagaggctgaggtgggaggatcccttgagcccaggagttccagaccagccctggaaagacagggagaacccctctctccaaaaaaaggaaacaaaaataaaatatagatggttgtggtggtctgtgcctgtagtcccaactacttgagaggctgaggtgggaggaggttcagttgagcccaggagttcgaggctgcagtgagccttaatggtgccactgcactctggccttggggacagagtgagacactgtctaaaaaagaaaaaaagaaaaaaagaataaggtttacaagcacttaatacaaatcattcgttaaaaataaaaataaaaatcagaatggaaaacacaatattgggatgctttgggaaaaagatgactgacaagatgttactgagctagagagacatagaccttcccttttttccaaggccccagtatctggatgaaaccaaaatagtgtgaggaagaaaactggagcaaacagcagatcagcaacaatgaagaatccaggagacaagcagagtgtatttggcccaaggccttaatattagtttgtgcactctgtacactgcacaaaggtgttcatgtgttacacagaaattcagcacttgctctgcttgcatgaagggtatggtgggcatagtgctggagtattggtgccttttggctttacatgttgagagttggctgattaataacattgtgcagatgatatgcaatgggagaataaatatattacttatttttaaaataaagctgattaatgtggaagttaagatttatagtattttggacaacaatgagaagttaaaaagaaaaccacaaattattctttattgcttattttgattttcttataatactttctatgttgcacttttcagtaacattaattttgaaaaagaggagagattttccaattagtggatgctttgaggtcaattttaggaagactatttggcaaatacttgataaggttatatttggtatagcttctttcttaggtgcatcaaaaattcatgcttttaatccccattaaaactaattagtgttaatgtgtgtgaacatgcatctacagcagaatagaatattagactaaaatacttcatcaatgattagtattccaaatgccagttaaatggtagtacaagcaaatgacatatagcacaaactatctaatttacatttttaatgtgatatgttttgcaaagatattgaaataaaatggaaggtaggctatgaatgccctgtaatggaacattcttaccttaggtcttgatagagtataggagaatagatattttaagatgagcatagttataaacaaaaaaaatcagatgaaggcgttgacttaagttggagaatgtgaaacacttgaactggtaggttgctgttctgtttgacactggtaagagcatctgcagttcattgaactggaggagaaacatttatccattggtaaaaggagacgaaggtgaaggtgggtgggcggcaggagttggagtactgacaagggctctaattgcaagaattagatagcttattgttaagggaagcaagatcttggcagtgttaatgatattattcattttttagatttttttctttcattttttgcatagagtagcattctttagaatgctctgttcctttattaacaagaagtattgaaagaggattttagtgatcagtttctcgtaagagatatgagctcaacaggggtgacgataagtcataaatatatttctgaaagtttctattccagtaatgagagacacagtaataatttggtattgattaatatctagtataataagagtttgcatgtgggaagccataggctacagatgttgattggtttaattggttaattaaggtacaaacaggaatgctctacactcaagttatatttcctgtgctggtaactagctgtaaatgatcataattaagacaatgggatatataaattgttgttaatgataattctttaccaaatttgtatttaaaatataaattcttgatgaagttctttcaaattatagtttatgaaaagtaacatttcttagcttcaaaaggtcctcaagaaatcatctagagccattgttcgctccaaagcagttatgtgtgtgatgcttcaatactgaagcctcttctgttgaatcttaaatgtctctgagaatgtaaaacttgctttgatttccattctgtcttctattcatttgctttatatctggatggtgaacggccgatgcaggcagtcatgggctggagctgactcataccaactggggatagcttcctggtgggtttccaggaatcatgtgagccagttgttaaatacagctttattaaacattaactatataaacttataattaaattatattaaaaacaaaagtatacatatttaaaagtcaacactttctaatgattttattgcaatatactgttatctctgctctgggggttattttacatctacacggtacgtattttacatacagtttgtatggtggaaattctgtataacagaggattatctattgagtatctcttcccaattgtacatccagtgacatcatattggtagctaaaatttttttatgaagtgtttatatcatagaaatatcattcttaagctccccaggccagttgttaaattatttactagcatatcaccaggcaggggctttcttcataaggccagtttttttccttgtaccaaattggaactgattcataagcttttaatgtaactaattaatgcatgtatagaaagtatattttataacctaagtgttttatttattgctttgaatacgtctgtaaaattgtttaaacataatagagaagtttttattttcaaaaaattacaatattaaatcctttggttttaataatagcttttggatctccctaaagtgttcatgcacattgcataactgatttgttggtaactgatctgtggctaaatgattcagaactgataatgggttataggttgcacttctaggtgagtgactagaatctagaatctctcactatgagggaaagttatttctgcttaatgagtgttgattagttcccatgaggaaagctggacttactccaacacccagttcttccacctgttggcatcattggtcctaattagcttcttccacaaggatgtcaagtaatcaatggtgaaatgattgaaataccttttgacacccacatctggttcttccaggctgggataatctgcattttccattgtccccacatcaaaatactaaatattctatcttgaagaaggcttcaggaaggtgatttatttgtgagcacaccaaaacttatttagctcataaaatttcttttctaattattttaaaaagcaatcattgttacaatgcggaacaaaatcctcttgtgcttcaaattccattgtatcattcttattttcatgaggcagatattaatatattctctttcacagatgagaaaactgaaatgtgggaaaattaaggagtatgttgaaattatatgttatgctattgcttaaagcatgagaaatgtagaaatgcagataacaaaactgtgtgtgtgtgatcttagattagatcttagattttggtattgtgactgcattaaaaaaaagagtcactcttctgggcttaggtcaaacctgttgtgaagagtaattatttaagcaaacaatttctttacatgaaatgtgattttaaaaatgtaatccagatgacttgagtagtaagaagagacactaactctgggacacggctttttcttttgttttgtttttgccatttctgttggtagaaggtagctttccctcattattgacatctatttttggaatccctcaggaggaatcccaatttatcctgaaacaaaagaatgaaatgcaagctttctgcagaccaagtattttgcagtttttgcatgctctattttcttcagccgatgaaccacttctgacaaagctttctcactgtccggatataatctgctaataccactgggacctacactcacaagtgtcttctttctccgtaaaagtttaagccactaattctttttgatgtctgttgggaaactcttccttggccttgtagtattgtgattgccaaagatttgaatgtggcagccagaccactgacagagtgtcttgaatgcagggccaattagagggaagtattagatgaagccactgaaccattaggaggcttgcaaagatcccctaagagtcttttcatctacaagagagctgtggttggaaatacacagatggagttgtccttagggatgtgctcttcccgcacgtggttctgttgaagcatttcacaagtagaagacaacgttttgtaatatttcacagagcctatgtcatacagaggcacattggtcatctattattaatatgtttgtttggctcaaccaaaagtgtctttatacacactttttaactccttccctactaatgatacatttattagagggcagaggttttgattaaagatataagtaatatgatttttatagctcagtttttctttcaacacaacacaaagtgaagcatattaattgtcttagtatattttccttattgatgaaaaactggtttggtatttgcaaaactctgcatgaattctaattccaaattcttgatttttgtcccactatatttaggaaataatattgttttcacatttagaggaccacatcaaggctaaaaagataattgtatttaaacatattttaagatgtttaaactttgtatttttatatttttagttatcataaaatttaatttgtttccaaaatcctggttaattttcattctaccaaatagaggtttaaaatgctcttaggagaatggtagtcaaaggtcttataaaaacagaaatgtacttctttagtcaatatgtagtttgctttatattaaatgaagaggtaatctggaatgtacatttggattaagtgtcagctgtaatgcctatgtgcttttcatggcccaaaaggaaaggaaaaacagtggagaactgttatcctacaggcatcagaattacgctgatgggccatcagctgctcggcagccaagcatttctccaaggtgctccagtgagtactgcaggctgacctcatggatgtatgggtgaagaatcacaactagatgacaggactagtattctaggaccaatatttaatgtgacgtaacttaatccaagttggtatatgattatgatagtagccaaaaatcagatgacattagaaataggtggcccagattgaaatagatgtgactgaaaacatagtgtagtaaaccactgcaaatttaatactcttcatctgtagacctaaggaataaaatcgttgaatatttttggacttattttccattcaagtatagaggaaatggtgttttgggcaggaccatattacgtatttatatatgaacttcgatacatgcaatgatgccaatttacaagaaagtcctgagtacgaagatctaaacagtaataaactacagacaaaagatgaatcagaagtgtaatattttcttaagctgtaaatattggaatgcctaaatataggctaattgctaaatatatgtagcaatccactgaacattggtcagatatatttaaacaaaggaatatgatagtttcatatttctaatagtgaagtattttcgaaactatacagtcaaacttgaagaggaagctaatttggaaatagttcagaaggaaaaatgagggaattcatattgcttagcctaatggtggattatttgcctcctaaggagctgtctcagaatgttgaaaggaatatattccccgctggccacctgcttctgccctgttttctccattcctggtgttattgtcccactttgcatgttctgacccaccccaattcctgagccaatattgacagagtcaagacagtgtgtatattatcttcagctcttcagttggtatccattaaaacattaattaaatcaaatacttaaacttctcttttttagaagtgggaagaataacaaggtaacgatattgtaagtggctgactagagaaacttgggcaccttccttattactccttccccacttggttctcaagcttccttagtggttcccaagtcttggtacctgctaactggtgattctaccctatgttattggtctgggcctatggatataataagatgcagttggagtttacttggcactgaagttagctacagctactgcttatgctctatgtcaagctcttactactgagaaagatacaagcacagaggcttctattccaatttttatgatacagcatcctcaccctgcaggaccctagctgcagcttgatctgtccagctgtccattgtgatggtaaaattacaacatcacggtgcatgtgccactgctcctgggactgtagcctggctgcgtcacaccatgaatctttctcactagccacatgttttgtgaatgtgacactctcatgaagactcttggaggtcacctagagcaatgttttatgatctgaccttttccacccatatggctgagaaaggagccatgtgatatttccaacatggccactttcttgacctaagaaaagagtgatatcagaagcatacagctcatggcagcacatcatggatgaaacaggtacataaaaggtgccattacagaaaaggagtttggcattaattttaagtcagtgtataagtgatgtattcttaactgtctactgcccaaatcattatttaaaactgctacctcgggcttgagagtacacgtatccttctttctactacttctttgcttttctcttcatcgtaaagccatgaaagtgactattctataattaatctcttctacaaactgccaggcataatcaaattctgtaaacacttttgtctaaacaagatgtgttgtgatgcttatggaagaatatttgggaaattatttctttgaagatctgtagaatagagtagattggggaaacttttgtccaaaaaggtagatacagccattattggaggcaaagaaataaactgagcagctttcagtaaacatctatagacacgtaattggtacatggcattggcaaaacaaacatttttaatatttatacattttaacataaatttaaaataatgtaactttatttaaatatgaaagtaaatctattttgtattttatttgtgtcttcaagcctattcccttctttattcacacttaaatttttaacactctgaagtagaatcgctggaaagctctgcatggtgaaaactttttggctgtatttttatagtacacatttttatacaaagatgtggcattaacactgtaaccgggtgacttcagatttttggacacaaggaaatttaaaacaattcaatacttttaacctttgtgtgtggtgtctttccagtttagtttgagatttttaagtatctgaaagttagtggcctcaatatggtgtgattcctgcatttatcacataaggccacagtgccaatgaacagtaccctggggacctatttttcagaattttccatggcccacaaaactaatttaaattgagttctcctttgctttaaagggaatttggtctcttcaccctccttctctccttactgtgtccctctgttcactcttctctgtcctatgtttgggtcctagaaagtctcctcttggactcctcagaggggagaaataaggggacaccaagcaaggagccctggacccctctcctggccttactccataggaaatgaaggctcagaggattttgagtgaaataaataagattctatgttttataaaacactggagtctaaataagacttaatttgggaaaggagttatactactgaaaacaatcataaaaccactactttagagtgtgacatgaaatagttcgagatttatgtaaccttggtaggaattaccatattaaaataaattaagatttctctcttcatatgcatgccttcttattaaatgatgtcaaaccccttttagtaatatacacatatgaaagaaaaacgattattttaaatagatattatcaaaatttcagacatattcgagggaaacgtagcatgagttagttttacatactatgtaatttaaaggaaatcttgagaaattgtaacatatgtctcatgtaatagttgtagttggctccatctgagtcaggaggcgggactcgactctggaggcggggctcagacaccagacaaggttgaggactagctaaaacagggaagagggagaagcgcctcttcctaagacaagctcaccagtgtgccaggtcagtttactgctgccatggcaacacccggaagttactgcccctttctgtggcagtgacccgacaactcaaaggttaccaccccttttctagaaatgtctgcacaatccaccctttaatttgtatataattaaaagcaggtataaatatggctgcagaactgcctttgagctgctcctctgggcacactgcctatggggtaaccctgctctgcaaggagcaggatctctgctgctgctgtgcattgccacttcagtaaatgttgctaagaccactggcttgcccttgaattattccctgggtgaacccaaaacctgccaggctaagccccagttatggggcgcatctgccctgcatcacatccatcattgctgtagtacagtaattacatttcaaacatgtttgcatgatatcatattactttcaaaaacataataattctggtttctgagttataacaaaatataaatagaattctcttattgtgttccacagtgacaattttggagcatgtagatatgattcagaattgaagcaatagaacagatcattcaatttgattttcctgcaaaacatttttccttatacagaaaacttgccagtttgtttcctttttaatagattactaagtcagtgaaacatggtaaaatttcagtgtttttaggttaaatatctgcagtttcttatgtttcccttaattatttgttatgattctcttggcagataacatgtgacattaatacatttaatattataaggtggttgtcttctctacactattatttcatgctaatgttccacattgctttactttttagttaaccttttactattcatatatatttttcttctatttgaaggatagaaagggtcctgccttacttgcttttgtattccccacagtgcttgtgtcctgatatacacctaacagttgttcaataggtattcactgacttcttggtaaatgagttattatgtttcctacaccatcaggatgattttggtcataggaagcagagaattcaggaaaaaattgcttaaacttgtgctactgaaaatatgtcccatagattgttggtcagaatacaaactgtttatttctgatctgcaagtagccaagtaattaagagcatgcatttagaaacatttatagcaactttaatgtatcatgacatccagtggctggtcatttattctaggaatttgtttttattgtattttacaatagtttttgtcctcaactgattgaaaattttaaaaaatctaatttcttaactacagggtgtttaagaagcacagatttagacaatgggtatttattaataacaaatctcatatagtaagaaatcaaggaagaaatagttgctgggttgggattcaataatgttcaacagtggtagggctcccagttgatgtttctcaggttcccttggtcttccagcttagctacaatatgccgtcagcagttacaagcctcatgcttccacatgaaaatactcaactggagaaggaagaggacagatgcagaacagcctcttctctctcacagctctctttttgtctggagagaaagactgtccatatctagaagactgttcatacttctttccatatctaattgaccagaattgggtccctgtcttcccctggatcaatccctgtaaaatggtcatggcttagtccagtgtgatctatcctctggggggacacctagctgcatgaccagagtcagggatctctcagcaagaaggactggagaatggctgttctgcaaatttctccaaagacctaaaattatcagaaattgacatcaccactgacaatatttcaataagtgggaaggtataaaaatagctcaagttttatgcaatacctgttatgttaggtattgtgcataactcttcatattttgtaaagcttccctccacacagtcagtattatccctcttttatagatagggaaaaggagacatcagttaagtgtttcacccaaggtcacattgctggccgataaacagagctgagattccaacctaacaccatgaatgtctatacccaggttctctctactgctacaaaggctatttttgtatggttctggttgggtagcttgtatatgcataatactacaaatctgggaatgcctgaccagggatactagcttgagaaaagggctctctaaataggcaacataaactctcttaacatttctaagtacagttattgcatttctggtacgtgggactttttcctttagctcactaaaatgtgaccctctctgttgctgtctgaaatacatcttcctgtacaacatctgtccctgtcattgctgttccagatgtcacaggaccctgctgttgtcttgagtttggatgtaatgtgcgggagatgtattctttgtaattctggaatctagaagaacattgctcaataaaacccctgtgcatggtggataagtattgcttgcaactttactaatactttatggccatgctatatatcaatagcactgtgccttagctaggctttcctgggctatgaaaaaacatttttaaccccagagagtgccaaacaaccaactttcaaacacttctttgcaacacagctctttgataagctgaaaattgcccagtttatggaattctttcttgatcttatacttcctcatattccaattccctagaaaattgcttttgagaaagagtagacagtatatctctggagtcgcccattattttttttactccactgctgagctaggtatacaatcctgattatctttgactatgttcctttctgtgggtgctagtctattctagctaatacagggtgcatagcaaattttaaaaggctatgaaaataagcttggggacacttgtcttcagtgttcaaatacgtagattttattatcacatttctgaaaatgtattacttattaaactatgtggatccaccttaaggtatgtttttcctttcacagtcctatattgttaatgatactcaattgtgagttactttaggtcagcaactttgacttgtgtggcatttgataatgctcattaatgttgctgacattgtctttggatggaaaacctcagcatgcatataatgcataatttcacgagattcactgttttataggaagccataaaaacaaaacatggggtataataagtctatctattctctaaaaatttccatgtactttcctttaagtataaaaaagtaatttatgttaaagtacgaacaatgaaaacaatttacttaatttatctttctttagctaatgcggaggtccttattattattattattattttatttttccattgttttgtaactcagatcacagagttttgtttgtttgttctgagagagggtctcactctgtcagcactggagtgcagtggtatgatcacagctcactgcagcctcgaactcctgggctcaagtgatcctcccacctcagtctcctgagtagctggtatcacagtcatgtgtgaccacaaccaacaaagttttaaaattttcttgtagagatagggtcttgccatgttgcccaggctggtcatgaactacttggctcaagcagtcatccttccttggcctctcaaagtgctgggattacagtcatgagcccctgggcccagcccatattataggctttgtactttcagctcatatgcaatgtgtttttttaattaaattttaaactataaatttaaaaattatagttgtatatatttatgaagaaaaaagttataatttatgagaactatgtggaataattaaatcgaattaatgcatatatcacctcaaatatttattttttgtgatgaaaacatttttactctcagcaattttgaaatgtataatacattattatttactgtgttcaccacgttgtgcaatatttcacaaagaaaaaaaaccttatcctgcctttctaattggctttatactctttgacaatcatctcctcattactcctgccaatctccaacccatggtagccagcatttcactctgtgattctttgagttcaattattgtagattccacatgtaagtgcgagcatgtggcatttgcgtttctgtgcctagctcatttcacttagcataatgccttccagtgaaaaacaagagcagtattgaagggttggctcaattgaagtttagcatgtcttgtgaaataatttttcttcctgttcatttgaaaacttatgaaaatattaaaaattggtactaaaaacataactgatatttttaaatgtcactcataagaacatacatattcatcacatttctcagtataaaccaagaaacataagaaaaaacatccaaaatacattttaacgtctttacaggctgctttagttttagttagaaataatatagagagtcaaagactcaaattataaatctaagtggctctgcattctgccaagattggaatgcagcatggatgaaatttactgtgacccaaactttcaacaaaatagttcatgacaacaagataggaccacaaatgaggttttttattccaataaattctttgacttatctgttcttactgttgtctttaagcacaagatttgtaggtggccgccaaattgggaattttagaaaagaaagttttaaatggaactgactccagctgggaattgagaactgtttggtgttttgtctgggaggaagtatcaaggtgttcctaagagctgaggtatatctgaaatggtagtatcaggaagtttgcagggttagtatgaaatgaaatgaaaatttcaattgtactgtatcccaaccaataatataatgtcttccttacataatgagcataatgctggagtttcacatagtaaagagtaccaacaataaatagactcatgttagctgttttaattttttcaggatatgaagggtctcattggtgtgatagcactagagaggatttgggattttttccccgttttaaaaaaattatgttttagagatcatctactacagtcacttttgtcagtgaagagagaattgatttcagctctagtgattcttcaaagaacattctagaatgctgaaatattttggttcctcagctttattatccacaacacttagggaaactccacagagatgtgttatgagctggaagccacttgcctccatgttgcggtgaggggcaggattgctgggtggaagcgttgtgctatttacgtagctcagctgaacagttcacagagatgtggctattatagaggcagtaacgttaacctacaaaaaatatctgccctccaaccagtctcagataaaacagtagaatcatagattctaccaggaaaactgctcaattgtttgttgtataaatggattgttgtacaaatgaataaatgagggaataagtggatagaattttggaatgaaaatgttgttcctagattcaagttattcaataattttcctttggaattcatacagcagatcatcccaacttgattcttaacccagggcagcattgtacttttctactcgcctaggacatttaagcctgtgtggagacaagtaggttatcatagtgttgggagtatgggggatatgagtgttgtggttacttagttcccaaagcactgaaatgctaacgccagtgatgaacaggaagtcctgtgcaacgaggaattcttgcctacgatagtaaataatatccccaatgagaagcagtgagtctctctctgggttctccgacaggaaggctaaagacaaaagtcctcatttctcaagtaattggcgactttgttggacatttaacattcaaaaaagacttcttatactttgccaaaacattgcaaattgtactcagtaccagctttgtccttcaaagaatagagacctgccagcttctactaaggttattcttacaactcatttacccatgttgcccatctggttactttcttgagggcgctatgcaggttgtctctgtccctgtcaaggtgaggcattcagaactccatccaatcctctaactatggcctgccaagtggtataaataacacgtacagccctagcggtcatagctactattttttccttagttctgcaaactaagatggcattaatttttttaaaatttttgttagcttattatcaactaaaacttcagatcttcacataaactgttgtcagtctgagaatccatcattctgagctagggattagcaagctttcttggttaagggccagatagcaaatactttagataccaaaggtcattcagtctccatcacaactactcaattccacagctgtagcatgtagccatggacaatacagaaatcactggggtggttgtgtttcaattaaactttatttgtagaaacagatagtaggatatattcggctcttgggccatagtttgctgatctttgttctatacttaaagaaatattagattaaaatagaaatttagtgctttttaattatgtctgttcatattattttgttgatttcagccaatcattccaaccagctgagaacctcttgaattctaattgtgggagttctgttatttaatttaattaaaaaaattatgctgcttttcaactttgtatcacctaacacatgacttctttgcttttatgtattaatagttcttctccattccaaaacaaaaacaatacctgaatagaaaaaagccttaaaaaggccctataccatatactagtttttcagtttaagatggtcagtgatacaattgataaacatgttttggttactgtaatgataaaactacaccattcttctatcatgcagcagacagttctttctgttctttataggaagtactggcccttgtctgcatttccttcccgaaatcaagatgcatgtctatgacaagttcttgttgtgccacagtgttaataccaacaaatctaatgttggtcaaatataacaggcttttaggaaatcatctgtttacttatgtatttttgcagtcagcttagaagagatgtgaattttatcagcccagccctgtaccctcttatgagatgtttacccaaatggggctttcattcctttgtagcatgaatatgtaaacaccttactacggttctgaaatcatagttatgagtccattagcaccctaatgggaaggaaggagttaactgtgatatgtaaatccccccttcctttcctgaagacaatctgggccaggtgctgacctccaccaggcctcctgtaaacattccaagatttagtaacagaaagatgacctaggaggttcaaatataagaatgtttttatttgggtattctttttctatctcgattacttactataactaaacctggaattcgtgggtttatttgatgcctatggctggagagtggaagttagtccaatgagctctttatctgcatgagaaataagtaagaagccttaaacttattattatttgttttctgagatagcttgcaccacacacataatgagcattcatctgttattctggaaccaaactgcatcccatttgaaaaaaagcaattttttggagactgtgagagacagttgaagtcttttttgttactgcctgtgtttctgttgttactatatgcttcactaatctccattgaagttgggtgtagtctatgatctgtgattcctgtgaaccagctgtgataatgtaactctttgggattctgcactatgataaaatgcagatggtcctcagacttgaatgcatctaaggcgttggggaaggtctctggttgctttacattttcttgattttttttctatttaaacaaagcagtttaataaatttctaatacattttcttgctccagactgcctggaaattcatttttttttaaatttagttattattatactttaagttttagggtacatgtgcacaatgtgcaggtttgttacatatgtatacatgtgccatgctggtgtgctgcatccattaactcgtcatttagcattaggtttatctcctaatgctatccctcccccgaccccccaccccacaacagtccccagagtgtgatgttccccttcctgtgtccatgtgttctcattgttcaattcccacctatgagtgagaacatgcagtgtttggttttttgtccttgcgatagtttgctgagaatgatggtttccagtttcatccatgtccctacaaaggacatgaactcatcattttttatggctgcatagtattccatggtatatatgtgccacattttcttaatccagtctatcattgttggacatttgggttggttccaaatctttgctattgtgaatagtgccgcaataaacatacgtgtgcatgtgtttttatagcagcatgatttatagtcctttgggtatatacccagtaatggaatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgcattctaactggtgtgagatggtatctcattgtggttttgatttgcatttctctgatggccagtgatgatgagcatttcttgatttcttaagttaaatttccttttaaggtatttgttatttgatgttccattttgattagaaaaagtggagaaagaaattttgtaattctgaattttctctgttatttcccccacattatgagcctattaagctgattgcttccatattgatagacttacttcaaattcttttttgtaatcataaaaattcttccttttctagtttaaagaccagcttttatgaccaactaagaataaatttaagtgtgtgaaacatagctaaatgtttttaggttaaaggagtagaagaatcctatgaaatttacatttaaaagcttatttagtttagtgcaatgaatcacatttggcatattacaatttttaaatgctaatattatatttatcagcaaattatttgcatattaccataatgtgagtctttaaattattttgatattgaaatggagataatatattgaatagtatcgactcttctaaatttgatgcttaccgtttattttcttcttggaatatcccatgcatttttagatgcttaagaaataaacttattgaggctgtaacagctatgtagaaactcagggtatctttttttggtttaataatacccaaaaggttggaaatgtacaaaaaatattaaatctgagagcatggtaagttactgtatcggtctactatgtcagttctgattttgacttttttcttttttcttttatttttttgagacagagtctccctctgtcacccaggctggagtgcagtggtgcgatctcagctcactgcaacctccgcctcctgggctcacgcgattctcttgcctcagcctccttagtagctggaattacaggcctgtgtcaccacacccagctaatttttatatttttagtagagatgggatttcaccatattggctaggcttgtatcgaactcattacctcaagtgatccgcctgccttggcctcccaaattgctgggattacaggagtgagccactgcgcccagcctgattttgacttttttcattagcaatggaggagaagtatttcagagtagtgacaaggcactccattgcttgatggcagcactggatataagaaaagaaatctagatatagatcaattattgtgctgctgatgatctcaagctctgtactaatgagcagttacgaaaatgagagatgatgttctattaagtacacacatgcttcatgtggattttgaatgtacctacgtatttggttttgtctgttaaaatcactttaaaattaggttggcaaatttcccaatttattaatttatctatctttttcaagatagaaaaaagtaatgttcaagagagtgttatgaaaggttaaacgtaaaggccaggaatttgtaattactagcagtcatgctttgctaaattaatgagaagataattgtcaatacattttttggtaggaatagttttgtttaagtcaaacattgcattaaaataattatttggactctttttagaatacaactgtgatttctctgcttcattttcagtggtgaataaaatgcatgttttaatttttttctatgtttaatttttcctagaactctatacttttaccatataagattctaaacttttgaactttgaattctgtaagtttttggcattataattttaattaattgttaataatagttaaattttattgatcactgggtttcaaatttaataatgatgcatatggaaagcgtttttcagaaaatgtttaaaaactatttttgaaagtccagggtaaatactattgaaattaataaaaatttgttattacagaacaagcatatttcagctacatttttaatgaatctgtcaaaagagttattgggtaggaaattatataagtaggatacattttttcctagggtatttttttgtaatctgcatgattactgttttgtaattgaacagaaagcagtttgtatttttaagcatctggcttttttcattattaaacttagacctaggtagaattgtggggatgtgtaggggtgtaggtggacgggatttattgatagctactaatgactgtctcccactcctaatccctctgaattgcccggtgttgcaaaccctccttctgtgggctttggtggtgactgacgtctcatgcgtaagaaaggtgagtcattatcctttatacaacatagcttgtgtggtatgaaaatttatcatcttctctgaaactgtctaatatgtagtcacctctaaagtaattcacttaagctaagttatttttctagtaagaaatcccaaaaagggggatttaaaatttctcttgtgaaaaaggttaaggtaagttcagatggattttggatatggccttgaataaagttcactttacttacttttaaaatccacttttaattttctgaggacttctgcttctggcaaggatgaagtcggtggttttgaatatactcttttgagggtaatagctatatcactggataaaatagatgaggcagtagttttcaggcactgcacaacaggtaatgtgggactatgatcttgagataaaggagactttacctttaaggtgcttttccagtgtagagcaagaacctggagcccaaccggagtacagcagtcttgctaacatgacaagacaggtattggagatcagcacggagacaggcagagcaagtaagagaaagctacatagagaggaacaaggcgttgatgtggttctgtctcaagacattgcctatgacctgggccgccacacatgcctggattgagactctgtggagcctctcctagaaaagctgctgcaggatggagagctgaagagactcaggtcatgtagactgaagaggcctccctgagaagtcctaaggcagttagtaccataagggttatgccaaggagtaagtcatcataccctagaataagggtcacatgatagaactaaggaatgaagcaaagtagacccactgtacaaagcataaaaccatgcctgacaggacccagagatcctactgctggttttttttttttatactttaagttttagggtacatgtgcacaacgtgcaggtttgttacatatgtatacatgtgccatgttggtgtgctgcacccattaactcgtcatttacattaggtatatctcctaatgctatccctccccactcccccgaccccatgacaggccccggtgtgtgatgttccccttcctgtgtccaagtgttctcattgttcagttcacacctatgagtgagaacatgtggtgtttggttttttatccctgtgatagtttgctaagaatgatagtttccagcttcatccatgtccctataaaggacatgaactcatccttttttatgggtgcgtagtattccatggtgtatatgtgccacattttcttaatccagtctatcattgatggacatttaggttggttccaagtcttttctattgtgaatagtgctgcaataaacacacgtatgcatgtgtctttatagcagcatgatttataatcctttgggtatatgcccagtaattggatggctgggtcaaatggtatttctagttctagatccttaaggaatcaccacactgtcttccaccatggatgaactagtttacagtcccaccaacagtgtaaaagctttcctattctccacatcctccccatcacctgttgttttctgactttttaatgattgccattctaactggtgtgagattgtgtctcatagtggttttgatttgcatttctcttatgaccagtgatgatgagcattttttcacgtgtctgttggctgcataaatgtcttcttttgagaagtgtctgttcatatccttcacccacttttgatagggttattttttcttataaatttgtttgcgttctttgtagattctggatattagccctttttcaggtgagtagattgcaaaaattttctcccattctgtaggttgcctgttcactctgatggtagtttcttttgctgtgcagaagctctttagtttaaatagattccattcgtcaattttggatttttgtttccattgcttttggtgttttagacatgaagttcttgcccatgcgtatgtcctgaatggtattgcctaggctttcttctagggtttttatggttttgggtctaacatttaagtctttaatccatcttgaattaattgttgtataagatgtaaggaagggatccagtttcagctttctacatatggctagccagttttcccagcaccatttattaaatagggaatcctttccccatttcttgtttttctcaggtttgtcaaagatcagatggctgtagataagtggtattatttctgagagctctgttctgttccattggtctatatctctgttttggtaccagtaccatgctgttttggttactgtagccttgtagtatagtttgaagtcaggtagcatgatgcctccagctttgtccttttggcttaggattgtcttggcaatgtgggctcttttttggttccatatgaactttaaagtagttttttccaattttgtgaagaaagtcattggtagcttgatggggatggcattgaatctataaattaccttgggcagtatggccattttcacgatatttgttcttcctatccatgagcatggaatgttcttccatttgtttgtgtcctcttttatttcgtggagcagtggtttgtagttccccttgaagaggtccttcacgtcccttgtaggttggattcctaggtattttattctctttgaagcaattgtgaatgggagttaactcacgatttggctctctgtttgtctgttattggtgtataagaatgcttgtgatttttgcacgttgattttgtatcctgagactttgctgaagttgcttatcagcttaaggagattttgggctgagatgatggagttttctaaatatactatcatgtcatctgcaaacagggacaatttgacttcctcttttcctaattgcatatcctttattcctttctcctgcctgattgccctggccagatcgtccaacattatattgaataggagtggtgagagacggcatccctatcttgtgccagttttcaaagggaatgcttccagtttttgcccattcagtatgatattggctgtgggtttctcataaatagctcttattattttgagatacgtcccagcgatacctgatttattggtagtttttagcatgaagggctattgaattttgtcaaaggccttttctgcatctattgagataatcatgtgattcttgtctttggttctgtttatatgctggattacatttattgatttgcatacgttgaaccacccttgcatcccagggataaagccaacttgatcgtggtggataagctttttgatgtgctgctggattcagtttgccagtattttgttgaggatttttgcatcgatgttcatcagggatattggtctaaaattctcttttttgttgtgcctctgccaggctttggtatcaggatgatgctggcctcataaaatgagttagggaggattccctctttttctattgattggaatagtttcaaaaggaatggtaccagctcctccttgtacctctggtagaattcagctgtgaatccatctggtcctggactttttttggttggtagtctattaattgttgcctcaatttgagaacctgttattggtctattcagggattcaacttcttcctggtttagtcttgggagggtgtatgtgcccaggaattcatcaatttcttctagattttctagtgtatttgcatacaggtgtttatagtattctctgatggtttttgtagttctgtgggattgatggtaatatccccctctatcattttttattgcatctatttgattcttctctcttttcttctttattagtcttgctagcagtctatcaattttgttgatcttttcaaaaaaccagctcctggattcatggattttttgaaggttttttttgtgtctctatctccttcaattctgctctgatcttagttatttcttgacttctgctaacttttgaatgtgtttgctcttgcttctctagttcttttagttgtgatgttagggtgtcaattttagatctttcctgctttctcttgtgggcatttagtgctataaatttccctctacacactgctttaaatgtttcccaagattctggtatgttgtgtctttgttctcattggtttcaaagaacatctttatttctagcttcatttcgtcatgtacccagtagtcattcaggagcaggttgttcagtttccatgtagttgagtggttttgagtgggtttcttaatcctgagttctagtttatggtggttgtttagatatattaagcatgtatttatatgcatatatgtaaacttatgcatgtttgtcatccagatatattatagtgtgagttcacattttcttttatgttgagcaaatattcaaattgaatacaggaagcccaagcattttatgagttctgatgacaaatatcacaggaaggacaaaaacaatttttttttaaaaaagcatgcttgttcctctcacatctcatgtcctgtcacttcacctaaattctctgtcctccctcaagttatcttttttttttttaattttctccatgttttattttcctcctggatctctctcgagacatctgtaaccaacagaaattagatgcacaaatcctttttgttccggggggctttgcaaacagtttactctcaagccgaccccagaccctgggtttctcatgtggtcttcagactacccatattacaatagaaaacccactcgggaaattggagctgacaagtcttgagatggttatcccactaatttccatccctgcaccatttactaaaagtgatacaggtgggtggaaatcaggtgaggcctgcttctcagaagtaaccaaagatgcctgcacacctctgtgtgtccctcggcctattcttcccgggatggcgaatgtagtcaggtgtggggcctgggcttgtagggatacccaaaaattttctagggaagtaacctcactttattagagcttcttgtctcaattcagagtatagatttttgaatgcgtttgctgacagattgacctggactgtgttttccccttattcagggagcgatcgatctttatcaaaaggatttgttgactgatgggctttcacagttctaatgtgctgtttgatacttttaaaagacatatgcccctttgtataatgaaattacctgataaaacagggaatgaagctcaggttttctgaagcatcttagctcttgactgctttggtgactgccagggaattttgtttgtatttgcctgtgatggaaaccttacaaccttagtgaaattgtttttgaatattcaagtttctagaccatatactgtccttctaggcctaagggcctgaactaaaccaagattgtgtttccctcaggtaagtacttccagacactctatcctctctgtctttacaaccctcttctcctcattactgtactatgtaacactagatgcgcattatagtccacataaaaagccatttctgtagcatcttgtcatcggttcatggttgtgctttgaagccgtgttgagttctgaactcagagcctaacagcaatggctcaagtgcaccacaccgtattatttacccagatggggttaattgttaaataaaagaatgggccctttcagtttacttttttgcagtctctctaacactgattatggaagacagggaagactatgataaatatcaaactttctaatcagaaacgagtccagttgtatttgaaatcttgaacttaatccagaattagaaaatgtccttaagttatcttttgctttcttgagaccatctgctcttacgtggctatttttttttttgagtttctaaatatatttgtgtcaatcctgatgacaaacccatttttcagttccttgaagtggttgtggagacaggactgttccatagaacaaaacattactcaagggtcatggataacaagcaaattacacaaatagaaaatttaaattggatccctggtttggtccacagatcaaagttctttcacaggatcccttactagaaaattttccagtacctggattaacccaaagttactattttaaatcatatatatgtcattatattttctaactaattattgaagttatataccatattttttctaactgattattgaagtaggattttaaattatcttatatatttcatctttgatttaacagtgtttcaggagattcccttaatttaaaaaataatataattttataagctgcaaataatgacaacttttcttccatcttctttgcacagtatgtcacagcatttctgtttgtcctataatggtcccaaaagccattttaggtgatacatggacaaatattttattttagaaattttgtatcttgtatactttcaaaaaatttacagtaaaaaacatatgaaaggttttttatttctttgggaatactttaaaaattaatgtattgatttaaagagaaatcatacaacaggcatcacaaaagcattaaaaattattaaagtgacgtgtaaaaattcttgtgcatggaaaaactgaaatgccttcctacctgctcattatgaactcttcttccacttttcctttttgagacctgtgaccacatagccgagaatgtcacgtgcatatattctccctaggaaaatgggagtcccagaaggggtatcagagaaaagtttgccagggtgaggtgggccaacaggcattggtgctgtctggctcacaaaagtatgtttgtgaaactctggggagctgtcaattttctggttgttgtaacctctgtgactgggacttacggggagacagtggtggctttctgtcttcttccactttttttggtgctgtccttgctgtgctggttaaaagggtagactgtacccaggcgcggtggcttacgtctgtaatcccagtactttgggaggtcgagggcagatcacctgaggtcgggagtttgagatcagcctgactaacatggagaaaccccatctctacgaaaaatacaaaattaggcgggcatggtggcacatgcctgtaatcccagctacttgggaggctgaggcaggagaattgcttgaaccttggaggtaggtggaggttgcactgagccaagattgcgccatttcacttcagcctgggcaacaacagcaaaactctgtctcaaataaataaataaataaataaaataaatgtagactgtgtggtgcttagtttcaggaagtaaagctcattcaagatccagcagtaacaaagcactctgggtagaaaaacaggaagaaagggataaaacatgaatgtggtgtaattgagatgcaaaaaaaaactctgaaaactggagaatctcacctatgtaattacctaaatgcaggtgaacaagaattcctgggtaactgtggttcagatttcctcaagggcatctgagttcagtggttcagacatgcacctgtgagtaagttggtggggaaaattgaccttttagtttttagattctctttagtgaaaaatagcaaagcagttttttaaagtgtgggttcaggaatatactagaatgactctgtaatttcatctcaaatatattgctatttttagaaactaaaggggtactatcctggggctcttcaatactcatcataaaaccaatcctttaatcttactcctggtgtatcccacgcttcgcagatgctaatgtcccccaaatctaggtttcactagaaaagaaaacgtcactgtaaaatggagaatgtatgtgttctaaactattgatctgaagttgccagctataaaatcttggcaaaataatgcttctattgggttgtatatttcatgatgatgaaaagttgagagaatacataaatgtatactgtgcttacctacagaaatagcgtctgctttatggggggaaattctagctttgttgtatctcattatcaggagctgtggtattcttttaaggagtccttggaatgagagctgaagaggctgaaccaaaagtcagcttgtggctagagcagattatgtggaggaactctttagagagtcgctgaaccctgccctgggtttcattgtgtgttctgatctctcctcttctgctcccagtggggctctgagttagacttcaggttttcctcagagtgactctcagagctctctgtgtgagcatagctggtattggtccccctgccatctgatgtcaccacgtgaatttaggatgaagcctgatgcccaagggccttcaaactccactctgtccaatccctttttctttgaacttggcagattagggtgacccagtcatacaaaaatatctgaaccagacagcttgaaagcaatggcagtttttcttcacttaagattttacctaatttatcaactcaattttctatacttgaatattggtggaaaaaaggaaatgctgaattggatgcagctattctagacaattgaatctgtgtattatgcatgtgggcgtatttatgtatgatgcaccttcttccatttactgtacttgcagtggcttacatatttttatgtgcaagatatttatttatatctgcatccaaatgtctagccaagtactacgtatattataggcactcagtaaatgtttgttcaatcaaaatgactttaaaatagagtaaagatgatttaaaggaaggaagtgatcattccagatatctgaatacaacagaatattatcattgggccattcatttgattgtaagcttcttaaattcaggacactaacccctttgtaataaattgtgcaggatttagtttctcacaaaacagtgcataacaaccttaccttgaaagaaaaggaatacaaaatttatcttagcaggctatacataaagacgtggtgaaatatagtggttagcatccttgactcttttgtatttatataaaagaagatacagtatttttttttaaatgaacagtgctcatatgcccactctcaaagctagaaggaacaatactgaaccgtaatttaatgaaggaattctctgtggaagagagataatgttgtctaggaatcctctgtttatagtgtaatttaatacaataggacttgaataatttaaatgaataggtttctattaaaccatcactttcaaatagtattcttggccagtttccagaaccaatcagtttgtgattccttaacaattgtctgtaccatggcaagtcactgctactgattaaataaagaatctgtactttcaagtactgacatgaagaggcaaaggtgaccttcagtggtgggtggcttgggagcctgacttgtgttctttgcctggacagaagccagttcatttcagcataagattgagctgcaggggagtctttggggagcaaatggaaatgtgttaatggcatttgtctgtactttgaatagagatacttggaagtatgtttgtcttattgttttccttcattttagaaaatttattttggactatttctacactctttgcagacctttgaggaaaacatcttatatgaagggctgaaagggtagcttcagtgtatttcaactggggcatggaaatccctggattattccctcatactactatctgcatggctcagacaatgggacattcctttatatccatgccctgatttttgcagaccaaatcagggcatggatataaaggaatgcccctcttgtctgagacatgcagattacagtagccctttggctcatacgaggttgtgataatgtaagtgttagattagtctctggttctgatttttagaaggtttaagttctagtgtccagcaaaaatgcatcagtgaagctgacaggtgcgtaaggcaaacatcataatgatattagactcagcgtgatttcatgcattaatatggagtttgggttacgctgacctcacatcctggtttgaatcctgattcattgagcagcaatgtgaactagggcaacacaacaatctctgagcttcagttttgtagttttgtagtctattaaaatggaaataaatattaacacatatctttgaggcttatttatatagtcatagtatataggtttctatttctcagctttttggggggaattcttgaattcttgcatataaaataagatctctttatttaacaacagaaaatcctgattgttggattctattagcacctctgttcggttagaaaacctactaaatgtaaaataaaatttctcttaggagtttttttatgttcatttatcaagatttgatctattaaaattttagcctattaaaatattctggtgtctcatagcctacagaaaaagtgcacattcttaacatggtccttccacattctgattctaacctggctattctttgtgtccttctggtcatctccctctactgtgatcttcctgcagactcctttgggaagcacaggcatctcatgccctctggtcgtgctctaatcacattgacttgcttagcctccgcttaacctgtatgttctagcacttcctagtttccacgtgttttctcacctaatgacctctttctcttctttctaccttcacctgacaatagcctatgaaggcttttattctcagtttatatagctcctcttcaataaaacctcctaaccctccgagtaaaataagcctctccatttgccttgtgcttctacagtgcctttggtagaatcacattctgcctttgggtctatatacatgtcctgcgtgttggactgtgggcttcgtgagaacagtgttttcatcagcgtttaccttacataggctagttcctttctttttatcttttttaattatactttaagttctagggtacaggtgtacaacatgcatgtttgttacaaatgtatacatgtgccatgttggtgtcctgcacccgttaactcattatttacattaggtatatctcctaatgctatccctcctccctccacctacctgacgacaggccctggtgtgtgatgttccccaccctgtgtccaaatgttctcattgttctattcccacctatgagtgagaacacgtggtgtttggttttctgtccttgtgatagtttgctgagaatgatgatttccagcttcatccatgtccccataaaggacataaactcatccttttttatggctgcatagtattccatggtgtgtatgtgccacattttcttaatccagtctatcattgatggacatttgggatggttccaagtctttgctattgtgaatagtgccgcaataaacatacgtgtgcatgtgtctttatagcagcatgatttataatcctttgggtatatgcccagtaataggatggctgggtcaaatggtatttctagttctagatccttgaggaattgccacactaacttccacaatggttgaactagtttacagtcccaccaacagtgtaaaagctttcctatttctccacatcctccccagcatctgttgttacctgactttttaatgatcaccattctaactggtgtgagatggtatcacattgtggttttgatttgcacttctctgatggccagtgatgatgagcatttttttatgtatctgttggctgcgtaaatgtcttcttttgagaagtgtctgttcatatcctttgcccactttttgatggggttgtttgattttttcttgtaaatttgtttaagttctttgtagattctggatattagccctttctcagatgagtagatggcaaaaattttctcccattctgtaggttgcctgttcactctgatggtagtttcttttgctgtgcagaagctctttagtttaagtagatcccatttgtcaattttggcttttgttgcctttgcttttggtgttttagtcatgaagtccttgcccatgcctatgtcctgaatggtattgcctaggttttcttctagggtttttctggttttaggtctaacatttaagtctttaatccatcttgaattaattgttgtataagatataaggaagggatccagtttcagctttctacatatggctagccagttttcccagcaccatttattaaatagggaatcctttacccatttcttgtttttgtcaggtttgtcaaagatcaaatgggtgcagatgtgtggtattatttctgggggctctattctattctattggtctatatctctgttttggtactggtaccatgctgttttggttactgtaggcttgtagtatagtttgaagtcaggtagggtgatgcctccagctttgttcttttggcttaggattgtcttggcaatgtgggctatttttggtttcatatgaactttaaagtagttttttccagttccatgaagaaagtcattggtagcttgatggggatggcattgaatctataaattaccttgggcagtatggccattttcacaatattgattcttcctatccttgagcatggaatgttcttccatttgtttgtgtcttcttttatttcgttgagcagtggtttatagttccccttgaagaggtccttcacatcccttgtaagttggattcctaggtattttattctctttgaagtgattgtgaatgggagttcactcatgatttggctctctgtttgtctgttattggtgtataggaatgcttgtgatttttgcacattgattttgtatcctgagactttgctgaagttgcttatcagcttaaggagattttgggctgagacgatggggttttctaaatatacaatcatgtcatctgcaagcagggacaatttgacttcctcttttcctaattgcatatcctttatttctttctcttgcctgatttccctggccagaacttccaacattatgttgaattggagtggtgagagagggcatccctgtcttgtgccagttttcaaagggaatgcttccagtttttgcccattcagtatgatattggctgtgggtttgtcataaatagctcctattattttgagatacgtcccagcgatacctgatttattggtagtttttagcatgaagggctattgaattttgtcaaaggccttttctgcatctattgagataatcatgtttttgtctttggttctgtttatatgctggattacgtttattgatttgcatatgttgaaccagccttgcatcccagggatgagaccaacttgctcatggtggataagctttttgatgtgctgctggattcagtttgccagtattttattaaggatttttgcatcaatgttcatcagggatattggtctaaaattctctttttttgtgtgtctctgtcaggctttggtatcaggatgatattggcctcgtaaaatgaattagggatgattctgctttttctattgattggaataatttcagaaagaatggtaccagctcctctttgtacctctggtagaattcagctgtgaatccatctggtcctggactttttttggttggtaggctattcattattgcctcaatttcagaacctggtatgggtctattcagggattccacttcttcctggtttagtcttcggagggtgtatgtgcccaggaatttatcaacttcttctagattttctagtttatttgaatagaggtgtttgtagtattctgtgatggtagtttgtatttctgtgggatcagtggtgatatcccccttatcattttttattgcatctatttgattcttctctcttttcttctttattagtcttgctagcagtccatcaattttgttgatcttttcaaaaaaccagctcctggattcatggatttttcgaagggtttttgtgtctctatctccttcaattctgctctgatcttagttatttcttgacttctgctagcttttgaatgtgtttgctcttgcttctctagttctttcaattgtgatgttagggtgtcaattttacatctttcctgctttctcatgtgggcatttagtgctataaatttccctctatagactgctttgaatgtgtcccagagtttctggtatgttgtgtctttgttttcattggtttcaaagaacatctttatttctggcttcattttgttatgcacccagtagtcatgcaggagcaggttgttcagtttccatgtagtttagatgttttgagtgaatttcttaagtctgagttctagttgattgcactgtggtctgagagacagtttgttataatttctgttcttttacatttgctgaggagtgctttacttcgaactatgtggtcaattttggaataagtgcagtgtggtgctgagaagaatgtatattctgttgatttggggtggagagttctgtagatgtctattaggtctgcatggtgcagagctgagttcaattcctggatatcttttttacattctgtctcgttgatctgtctaatgttgaccgtgggatgtgaaagtctcccattattattgtgtgggagtctgtgtctctttgtaggtctccaaggacctgctttatgaatctgggtgctcctgtattgggtgcatatatatttaggatagttatctcttcttgttgaattgatccctttaccattatgtaattgccttctttgtctcttttgatctttgttggtttaaagtctgttttatcagagactaggattacaacccctgctttttttttgttttccatttgcttggtagatcttcctccatccctttattttgagcctacatgtatctctgcatgtgagatgggtctcctgaatgcagcacactgatgggtcttgactctatccaatttgccagtctgtgtcttttaattggagcattaagcccatttacatttaagtttaatattgttatgtgtgaatttgatcctgtcattatgatgttagctggttattttgcttgttagttgatgtggtttcttcctagcctcgatggtctttacaattttgcatgtttttgcagtggctggtaccagttgttcctttccatgtttattgcttccttgaggagctcttgtaaggcaggcctgatggtgacaaaatctctcagcttttgtttgtctgtaaaggattttatttctccttcacttatgaagcttagtttggctggatatgaaattctgggttgaaaattcttttctttaagaatgttgaatattggcccctaatctcttctggcttgtagagtttctgctgagagatccaccgttagtctgatgggcttccctttgtgggtaactcaacctttctctctggctgctcttaacaattttttccttcatttcaactttggtgaatctgacaattatgtgtcttggagttgctcttcttgaatatctttgtggtgttctctgtatttcctgaatttgaatgttggcctgcctcactaggttggggaagttgtggataatatcctgaagagtgttttccaacttggttccattctccccatcactttcaggcacagcaatcagacgtagatttggtcttttcacatagtcccatatttcttggaggctttgtttgtttctttttactctttttttttaaacttgtcttctcacttcatttcattcatttgatcttcggtcattgataccctttcttccacttgatcaaattggctactgaagcttgtgcatgcatcgtgtagttctgatgccatggttttcagctccatcaggtcatttaaggacttctctacactgtttattctagttagctattcgtctaatcttttttcaaggtttttagcttcttttcgatgggttcgaatatcctcctttttctcggagaagtttgttattaccaattgtctgaagccttcttctctcaacttatcagtcattctccgtccagctttgttccgttgctggcgaggagctgcgttcctttggaggagaagaggcgctctgatttttagaattctcagcttttctgctatggtttctctctgtctttgctgttttatctacctttggtctttgatgatggtgacatacagatggggttttggagtggatgccctttctgtttgttagttttccttctaacagtcaggaccgtcagctgcaggtctgttggagtttgctggaggtccattccagaccctgtttgcctgggtatcaccagcggaggctgcagaacagcaaatattgcagaatggcaaatgttgctgtctgatccttcttctggatgcttcatctcagagtgacacccagctgtatgaggtgtcagtcagcccgtattgggaggtgtctcccagttaggctactcgggggtcagggacccatttcaggaggcagtctgtctgttctcagatctcaaactccgtgcttggagaagcactactctcttcaaagctgtcagacagggaagtttaagtctgcagaagtttctgctgccttttgttcagctatgccctgcccccagaggtggagtctacagaggcaggcaggcctccttgagctgcagtgggctccacccagttcgagcttccaggctactttgtttacttactcaagcctcagcaatggcagacacccctcccccagcctcactgcagccttgcagttccatctcagactgctgtgctagtagtgagcgaggctctgtgagggtgggacccttcgagtcaggcacgggatgcaatctcctggcatgccgtttgctaaggccattggaaaagagcagtattagggtgggagtgttctgattttccaggtaccgtctgtcacggcttctctttggtaggaaggaattctctgaccccttgtgcttcctgggtgaagcgttgctctgcccttctccatgggctgcacccactgtctgacaagccccagtgagatgaacccagtacctcagttggaaatgcagaaatcacccgtcttctgcatcacttacgctgggagctgcagactggagctgttcctattcagccatcttcagcctagttcctttctgagagtaggcactcgaaaatatgtattgacatgaattgatttgaaaaactttgatggagagtatctttccctcatattcagtattttttatttgactacacaaaaaggattataataaataaaattataaacattgaacaccctgctccatagagatttgctaacagatgtgttctttttactcttaaatactcctattttttgagacagagccttactctatcacccagataggtgtgcagtgacaagatcatggttcactttcagactcaacctcccaatttcagctattttcccaccttagcctggggaccacaagcacgtgtcaccatgctggtaaatttttgtattttaatttttttggtagagatggggtctccctatgtttcccaggctggtctccaactggtgggctctagctattctcccacctcagcctcccaaagtactgggaatataagtgtgagtcactgcacctggcctcctgtcgaaattgagtcaaagtaattacctacatagttcaaattctagagaggactcaacacttctatcctttccagaaacatacaaacacacatctctcaggtccttttgatattctggggcatgttccagtgtttgtgtcatgttgttggggtaaccttttacatggatacttggatcattttttcttctgtaaatctatgtggcacctgtccctgagactttggagggtataacaaatcaaggagtactttgaaaggaggcacaaccttaaatagaatagtttctttctttggatttgttttggtgtacctcatctcattaccaatgtgtcagccattgcataccaaatcaacatgtggatataagggaatgtgcccttgtctgagacaagcagattatagtagacctctggttcataggaggttgtggcagtataagtgttagattagtttctgactctaatttttgtaaggtttcagctctagtgtccagcaaaaatgcctcagtgaagctgataggtgtgtcaggcaaacatcctaatgatatcagactcagcgtgatttcatgcaacaacttggagtttgggttactctgacctcacatcatggtttgaatcctgattcactgagcagcagtgtgaactagagcaaaataacaattgttgagcttcagttttgtagtctataaaaatggaaataaatattaatgtatttttgaggcttatttatatatatgtagtatagcggtttctatttcacagcttttttgggggaattctccaattcttgcatataaaataagatcactttatctaacaaaaagagaaaatcctgtttgttggattctattagctcccctcttcgggtagaaaatctgctaaacataaaataaaatttctcataagtgttttttaatgttcatttaatgtcaacatttaattaattaattatatttgtttgtttgtgtattcaagaatgtttattgagaagctactttagaccagcaaattctatgtgctggggatatagcaatgaacaagacagacaaatctgtgccttcataaaattacatttctaataacctcacaccttagtgtaaatgttctgctttagccaagaccaacttgcacatcagcaaataaagctagtccatatttttgtttgacctgtaagactgtattgagttatttcaaaaatcactgctggctttgactacagcaaatgcccccttagtatttgctgtgatctgtgtaattccacgtggacctaaaactctttttgtgtttggagaaaagaagagttgttaaggagacacaaggatacaacaggactccttcatagggaaattaaagaagtggatcctggaatgtttgctgctatttcctgctgggatatagttaaaggtgagggagagtgaaaagtaggaggaggctgaataactttctgaggcagtcatgagaaccagactgctggaaaaagcttgactaactaaattgaatgtgttagtgtagactctctgtaatcatttcatcatgacctaccactaatttgtgtgggagttgaatgtgataggaacctaagatgctatgccaataaacagttataagaaattctgtgtgccttatgtttgaaaatctttgaacacaccatctcctattcaaggctggttgtagcatattaactgtaacttttttttaaaaaaagagattttacagttattgtaattaacatcttcaacagggcaagaaaagacaggatgtatttcaagtgattgaaaccttaaattttcacagtttagtgtgagagacactatgttagacttgtaaatttagcagatctgtattgagaggaaaaaaataaatatgcttctttggtgtccatctacatggcaacagctccaggattcctatctctagcccagactttctgctgtgttgcagatccatgcagccagtttcttcttcattggcctccctaatgtaagaattccaatatgtagcccttggtctcctcctccctctcatgcttctcagtggctttgcctatttttctacttctggtgcttgtctccacccatttgctcattatagagacccaagaccctcacattctttctcattgttctttcctgagccatgaccaagtcgttcaggttctatctccaaatagctctgcaatgcatttgcttttctctgccaccatgttttgctagatcactgcaatcacctgctaaatagactgcttggtcttcttttattcttcacgtgtcagccataaggatctttcactggatcccttccttacaccttatacaaaaattaattcaagatggattaaagacttaaatgttagacttaaaaccataaaaaccctagaagaaaacctaggcattaccattcaggacataggcatgggcaagcacttcatgtctaaaacaccaaaagcaacggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatattcagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccgtcagagaaatgcaaatcaaaaccacaatgagataccatctcacaccagttagaatggcaatcattaaaaagtcaggaaacaacaggtgctggagaggatgtggagaaataggaacacttttacactgttggtgggaatgtaaactagttcaaccattgtggaagtcagtgtggcgattcctcagggatctagaactagaaataccattttgcccagccatcccattactgggtatatacccaaaggattataaatcatgctgctataaagacacatgcacatgtatgtttattgtggctctattcacaatagcaaagacttggaaccaacccaaatgtccaacaatgatagactgggttaagaaaatgtggcacatatataccatggaatactatgcagccataaaaaatgatgagttcatgtcctttgtagggacatggatgaaattggaaatcatcattctcagtaaactatcacaagaacaaaaaaccaaacaccacatattctcactcataggtgggaattgaacaatgagatcacatggacacaggaaggggaacatcacactctggagactgttgtggggtggggggaggggaagggatagcattaggagatatatctaatgctaaatgacgagttaatgggtgcagcacaccagcatcgcacatgtatacatatgtaacaaatctgcacgttgtgcatatgtaccctaaaacttaaagtatcataataataaaataaaataaaggatctttcaaagaatacctctgatctgattctggcatgccccagtatcaaacctaccaactacttcccaccataattaagacggtaggccccagtatcaaccctaccaactacttcccaccacagttaagatggtaagccccagtccacagcagagactcttctgatctccacttccctccctggcatgagctccctttgtccactgcactgcactgcagccacactggcctttttttctgtgctcctaagtcccatgttctttctatcaggagctttcccaagtgctactcctcctcggtaagccatgtgtgtatcacctttcttgtcttctcttcgggatcagtgtaaggtaagggcactttttaaaaagaatctttccaacctaaatctgttcctccagctgtagatcttgtttttgtttttgtggcatttatcataaccagtagctagctattaacatatatattaataaatgtataccataatacatatattaataattatattaagtatgaatcaataatattaatatattaatatattaatagccatacattaatgatatataattatgagtgtgctttatgtcttccccaatacaatgcaagatccctatcacttgacagtttcctatcacaatacagcaggtacttcacaaatatttgctgcatgaataaatgaataaatgaaaagtatagagatgagaagataatgttttccctgtatgtctaagacatagctttttcatgttaaataagcccatgcttctcatgaagctaaccaacttaaagttagtacaatggtgtgtacttgtaaacagaaaaaaaaatttgttgttctatcattttttgcacttttataaaaatttatttaaaattatggctaaacactgtgcaaagaagagaaaaacctcctctcccccacaccaatttattatcctccctgtttcagtggagcagtggatttgatgtgataggtgctcagatgaaagcactgtcatgggtctgtttcacagtaatggaagccacagtggcttggttgagtggcccatgtcagaaatttggccttgatgatgggattggaaatgcttattccctgttcacacaggttggactcccagggcgaccaagaggtctataattttgctatagtgagtgctcctcagattgagaactcaggattgaaagcacaatggttaactcaaatgaattttattttatcattacctttttttcatatgaagtcaagatttatattcaaactagttttagagaaatacacatttgattgtaaatttaggacttgatgttgactcaaaaaaaaaggaacacctctctgtgtattaccccaaatttttctgcttcctatttttatggcaatgttcatatatagtctactaaaataggtatttattttagttatgcttagaaacaagagacagttttaacaatatgtgaacacggaaaggctttatttttattgcttttgtcaccttttcttagagaaaaagaacacagtattttgttaccagtttcctggcatagttttagtttaaaaattgtcttttaaaaattgatatgctgctttaaattgtagtgtggatcagtacattttaaataagaaatttggagagtagtagtgttgtatttaaaatcatgatcagaacaagaatcatttctgtttcattggtaaaacttgaatggctaaaggattttcacgtcctatagtagctgtaacagatcgatactgttaactggatgcaacatttgtatccttagctgcatacaggtttgtatgcatggtggtggtggttggtgtgcatgtgagtcagtgggggtgggggaacccttctaagaggtggccacgggataacaatgaaaaaatatgttcacaatcatctgaaacctaatcatattttttaattcaacgtaggaaagaacctctttggaacagatgtataaacaatattaaattaaacgagaacaaacaaatgagattataatcctgctgttatttcacttaactttatctgggtaacatagttaaataaaggtagatctagatcataatgagtttatctactcaaagggaaaaacagagacttctgtgaaaagtttaatttctaaatataaaaagtaaaaatcacagtcaattttaaccttttattatcacctttaaaatatatttttctagcaattaaaaagtaaatcaaagtctatgagataaaaatattccagaaaggataagtaaaaagagctttaaaagtatcttatttggccaaaataattccttattataattgttagaatttatcttacatttttgcatttgatgtcaagtgaaaaaatggaaaaacacaattttcatataaattattgaaaaggtttggagaagtcacagtcagctgcagcaaacattttcttttgtggagcagtgagtgtgtgatggtgttgggagcacactgagtgttttagctccattgagttatttacatgttcttaaatgtgtgcctttcttttctccttagccagacttcgaatctcctttaatgtagaaatcattacgaagtacaaattagagtgaaaaacacagtgcagtataagaaaacaaaatatacattataatagtagtaaacttggcagaaattgtatagaactatgaacagaagactatcaaatcttctaaagaataaagactttagtacatgaagagactgggcattgctctattttggatatattaaatgtagtaaaagtatgaaatttttgcagtcgaattcataagtttaataaaattaaatcaaattcaaagaggaaattctataaattcaaagaaatcattctaatattcacttgaagtaaatagtgtatttttaatcataaaattaaaatgttatttaagggaaacatctctatagctagtgttaaaagaaaaactttagaaaaattaaattgtccggagtttaatggagcaaagaagtatttgccaattggacagctcccaaaacagaataggttcagagaggctctagcactgcctcatgattgaagatttatgaacagaagaaggaaaattacctatagaaaatagaagtaagatacaaaacaactggactggttacttggcatttgtctcatttgaacactgtttgaacagttgggcacctttgatttgcccaaacccagtgattggcttaagagtagattacagcccattacatattcagttaggttacaattcactatgtatgaaaaagccttctgaacttaaaatatgtaaggaggcagctttagactaaacttaacagtagcattgatatattaaaaagtgaattaattttcaaaacagcattttgtaggtttggtacacaaataggtttctgaaatagaaccggtttcccagaaatattttcttgtataattctaaatataattagtttttccaatttgaatcagcctttcaaagaagcatatacaaaagcaataaatataaatgtggctgttaccatgctgctaaccaaagttgaaaaaagccagggatgccaatagaaacttaaacgttctatttcatcttggaaagccttactccatgctatcttaccacctgtaccatttggaaattcttggttttcagcagtggccaccacagacttttgtaaaagtagcctgaatgccatcctttaattaatctgagtgttctcacttccctaattattctacaaggcttccaagatgaataaaaacatgttcatctagaactgcctccttacatgttcagaattctcaaatgaagctattcatggagtcatgacttggcagtgttttctatttcaggttcggcaaatgggtaaaccagggcattgatgtgggttacctactcattaggaagaaagcacttctgtatacttgctcattaatctcttctacttccctaaaccacatgaagaaaagacattctttcttcttacctcagctgggttctgcacttcttttgcagtccttttcatcaaagagagctctacaggtcaatatttcaaagactagacatcgtttctagctcctatagagaaaaatagttaaagtttgttacacagaggctcttttccccttagctcctttttgaaagatgtatcaataacaaagacagtataaacattaatttaaaatatcattttagctaagcttatactttgttatagtcacagactatcccaagtaagtgaccatgagggatgtcaatatacttgttggattcttgatagtgaattctggcttttcttgtagtgccaggacataaaaggtgctcaatgggtattcactgcatatagataaaatcctatcccctacattgtttcagaggtgaaaaagctgtcaactgatctccagagaaaatgttacagtttattttcttcttagtaaacaaaagcataagggaaaaatagaatgatagggcttgatctgatcataacaaagtattatttagggcatctttgttaaaagattcacagtttgttttctcatgctccctgggatttctttacagtggtaacattatatagaggtttgggctgttaactcctcccagattgtgtcacctaggaacacagtggcctcttgacacattcacattgcaaatcacttgagctgcatacctgagttctacttcaggggatgagtatataaggagaagaaagtttagttccctggtcattgttgtggaccctgggataacgaaaaacaaggtataacattcaaatcagtagggacaattgggaaaatgtgttctccagcagttgatttactgtgttttttaaaaacagttgtgctctttggtcactgaattggtgacaattaaaatgaaatgtgtgaagttgttgaatgagccctagataaacctaatagccctggaatgatccacagtgtgagcaaatttccgcattctaatttcctaaggttgtcacatggctcttgaaaaacagccaatgactgaggatccaatttctagtccactcatttcctatctcatgtatttttaatgagatctttcctccaaaaagttgtttgctaacagtgaactgcacttcagagtacccaaatgaagtttatctgaaccagatgatgctaattgcagaatagattgtcttaaaatgaagactccttttggaattgtaggttaatgtgttgaagggattcacacacataatttagaagctatgagatcttatacttgcgttttcaaagaatagcattgacagacaatccactttattgctttatctatcaagttggatatgatacattttagttaggaatcagcttattttttgagagttttaatttgaaaaaaatcagataacttcaaattccaagtcaaattgttgagactgtataatttaaaaaagtgcatattgaaaacattgcctgatgcataaaagaaatacagcctctaaaactcataacctaatgtcttatttttaatactgtaagattatttattaatgcctagaataaaaatagccatttaaattgtgaaggttgttacagtactataagtttaatttctaaggaagtatttgataatcttctacatctaatttcgattttgaaaaacacgattagtactgtcttttaaagaagttgccaggagcagggaagtaggaaaatggaacaagacttcaccttcttcctaatcagccacaagatcaggggtaaacctgtttttatatttaaattgaaataagatgggcatagccatcagcatatatacatcctaagggatggtgtaaaaatgagttgctgagaagatatgtgtctgtctaaatccatagagatttggccctacctttaagcagattgtccattaggaagagaactggtgcaagaaattttcagtgctctctcagccccaatctaagcacagagaaatgtagtatagcttggtgcaagtgttttttgtggagctccaattcacttcttttcttatatggtccactaagaagctgttttctaatgcataatttaatcttctgagctgagttgcttaggacaaagtagtcatctacatgcttttttcccccttttagtatgatttgtaatcagcacaaaattattatagacattttgggggaataatgtgatatttcgatacatgaaacaatgtgtaaatggtcaaatcagggtatttagcacatctatcacctcaaacatcatttctttgtatgtgtatttgttaaaatgtaaagatgcaaacataatgaagcaagaatggggaattgaaacccagcaggtatgaagtactagtctcaacctgttactaactgaccttgtcttctggggtaattacttaaacactcctgacctgatattctatgatttattcatttcccaccactgactggcttagaaaatcttctgatggaactcaaccagagtgacagcatcctgctgtggttgtgtccttggtgtgtggacattcggcatgacgttcataggccagcagaagctactccatactcaagtggaaaatcgattttgggtggaccaaatcttgcattataaaggctcagttgtactggaaagtgtcagagatgtgaggcaaaaatgtaatgaaatctcagttctaggcctcattagctatgtcaccttggtcagtcagatactgatgtgtaaaatgagaataattatcagctggtttaaagatcagaaggagggtctgtaaaggaaatagtacattgcctggcacagaatagcttatctttaagcaatggttattcttagtgtgtggttacatttatcatagcatgttactcaccattcattatataatacttaaaggattttttttttgtctttcaaccctcagtagcacatccatttttattgcttctttagttgttgatagctattttgaacacagatatttctatgaaatacgactttaaagctccaatggttacagatcattcaacagaaattgggttttaaagggagaaatcgaatttgagttagggaattccataacgcatacagatataattttgacaaggtcctactgcaaaaattgcaacaaccttaacaactcatcttgatgctgaacaatatggtcatggtcattagttaggatacacatggaccaatatacttcattaagtgcctgctgactattgcttctcattgacaaatgcattcctagagaatcgctatttttaaaactcaagtttcaactttctttctagaaattatggaagctatctatactctttccctgcatgtcctttaaaatatctgtccaggatgctgtaaatctctttggaggtctaaacaccatggtgtctccaggccctccctctgggccacaagcactaaagtgtgatgatggatggaaaagaatggaaggttggtctcgctggccttctccttctgggtcctaagcatttatggtcattgggtatgtgtcgttaggactgaggatcttgactcattctcattcgtcaaaatagcaaatgaggagtttgacctgtgagtcctgagcttactgcttctgctgttcaatgttccaagccatttccccatgtgctaggggggtcctgttggccagcattcagtggggcacaaaagaacatagtgtaggcatggggatgcctcctgacctactgctttcagtgtattccattttcttgaactattaatgtttctctaggaatttttgtctataataaattattttgattgcacatcattttcaagtattagttgtacaccatttgtgttaatagagttagtttatacctgccattaattcaattctgcttgtactttatcttagtatttacttcctctttaagtgcagacttttgttttcacacttttttgtattaaattttactatttgaggagagaaccaaattttatcattgcttgtcaaggagttcttgaaaggaggactctcttgctttttactgtacatggtgggggaaggggaggtgggcagtaattagatatctcccaagaattaagaaataatgacaataaaacatttcagaaagataaactattaaagcagaatgcaataattataaggagggcagtgaaaatcttaatgagatagtttttcccagtgcgagccctacctgactgactgtattcgtaaattaaagaaaggatgtgtcaatgcctagaaggctttgaaggctttgtgtgtgtgtgtgtgtgtgtgtgtgtgtgtgtgtgtgtgttgtgtgtgtgtttagtttatgtgtgggggaggagggagcaaagtgtggtatcagtcagcaatagaacataagaagagtcagaaggtcaaattttggcagtgatcattcaacatctgatggttttagtggaatcataggtttggccaaagagccaggtaataggattccatgttcaggatgaatgaccactgagcagatatgtacctcaaaccatcttagcctaatgccattaccctttgaaatgatataacaaacttcctggttctgatctcggtgctcaccaagaaaaattaaccttaatatttgacacccactgcagatgtgtccataggggaaagcatactggtcatgaccttacaagttctgcaacagttttatttctcagtatacattggaagaatcaggaaatattctcattctgctacttggatttttatgagtttgaataatttgaatccccttctgagaatgattcactgctggaatgtggtcaaatttctgaggtaacagagctgagggggctgccctggtgaatctcctgcaccccatgagtccttgggtagctaagcagctggtatctcctggtgacactgaccaccccatatgtgactccattttaaatatcctacttaattgtttaacaaaacacagctttttgtccccttatagtttaattcattctcttctagcaaaaaaaaaaaaaaaaaattctgaaagtcaatggaaatcaagccaaaattctatataaaccctgttccccttgtctctccttctttcctctctccctcctctctctctccttctctttatcccctcctctgtccctatctctctgcccttttatatatttaattttcttctttccttctttccacttgtcttttttgagcaccatgtgcgtcagacactttactaagtactaggaaaacaaaaaccttctgattttgtaggaagaaagagagacacaaatctgcagcaagttgaaatatttttcatctgtggcatgaattcagtttaactccacatgtatgttttgtgcctctcttgtgcacaatcactgttttgggttttagaaagattaaaatgcgtaaggcttggcctcaagttgtttgtatctacaaagttatattaaatgtttagaaactgtaaacaaataattctctaagcgcaacatgagaaatattatgtgaactgcatgaaactttttgagacaagaagagatagcacttctagctgaagtatttttggtaaagtgagtggtatcaggttgtgtagtatgactgttttcactatactaaggttggatagagagttaagctaggcgactgaagccaaagtagtcttgtggggaagatggactcaggcaaatagagctggtcagaagtgattgagatgctagggcttagagatgctgtttcctcaaactcaggacactacagtgaaatgggtcaggagaacatagcattatgtcaagagctgtgagtctaggaagaaaagacaaggcagacttgggtagataattaggttaaagctgaagccaaaagcactttcctcagatagctaattactctgaaaatatttaaataaaatgataccttttaattactttttcttgaggataactctgtgttgtttagtcagctgtacctcaaaggcttgttcatatgactgcatcctctgccactcctccctcctcacttgtatgactgggggtgattgggtgccttctgcttttggtgtttttgaggagtgatgtgtatgtcattcaagctaatgcataaagtaagtgtagttattaagacagctgatgggggactagtgagaaccttaattcaatttaaggaattgaaacttaatttgtgtggtgatgtgaggactttgaaattttatcagtgaaggccatgatcaagagctgtattttagaagattatgttaccaaaagcaagtgtggatacaggagaaaatttatgggcatattgcatcatcttgggaaaagatataaggatggccaactagagtagttgcattctgcatggaaggtcaccttcatgggtcatggtggaggtaaaattaacagaagttggtaatgaattaactgtgggcaacaatgggatgcaagagtcatgacattcaaagagcttgaatccaggtgacaagccagctactgtagaaaggaaggtaccattagcagaggtagagaagagagcaggtgcagaaagagatactaaattcagaaatagaaatttcagaactgcaaaacaaccttgcattttacagctgaagggctgcctgtacaactcattgaccaacgggagatctaccttcataataaaatatatattcttttgcctctctcttggaaaagtgagtcatttactcaaccatgtgttgatatttaaagggcttgttatttgctaatggttgttttgaaaatcagtgagattcagactagatagaaatgtcctgtgttgtatttaaagaaaataaaaccataattttaagactgaaaatatctatccattatgatgccatgctcaacccatatactaaaaggtgttttgttttataaaatggtgctcatttgcattttaagtctgaatttttaaaaataatatttgtacacctgttatatgtccaaattaagacaaatttgtttaattatgattaaaggaattgcaagtgtaacattaaaaaaagatttaaattgccaaaataaaattttatttgaatttctaaatcacatatgactataaaaagcatcctgtgtttactgagaaggaagtgtcctgcctgaatacttcctattttgataatgcacatacaagtcacattcagaaagactagaaagcaaggagctacagatctagctaaattgtaatttattgtggaagatacaatcatcactcaccttggtcagggcatgcatcatgaagctgatagttaacaggttctaagttatatttcaaaggaaaaataatagacttggttgcaacatgaatgcaaattatggctctgtactctcccaaatccttggctttgttacctccagagaattcagctgtgggatttcagacccatctagtgtgtgtttctatgattttcagttgaatcttgacaagtatgattattcagattttttgtactgtctgaaatagaaatatgttctgcatcataacttagcaggaaagtaggaaggactcttagatctttgaagcagccatgatagcttatagtgaaacttttgacataccagtatatctccaaaagttctaggcaaatgtgtaagcaacataccctgaaatagatgagatggaatatccctgaaactcatctatttctcacaattctgcttggaactatatatctcacattcatcctcaactataaattaattgcataaaccctgatacacatagaaaaattctaaagttattatgtcataaaatagaatggttaatgacacagtgtcatcctagtgacctagtagtgtaactggtttgttgctgtcataaaataaaatagtctatcatctattttcaactgcctcctttatattgagtcttatgaaatgcttcagtgtgagagacaataacatgctgaaatgggaggaaaacttgaagtgaaacttcagttgaaaaaaaatattggacttgaaggcttaaagaagatgataaatggcattgaagttattactatagaaatgaaagccaaattttgcctgttttttgaaagtattgaaacactgggaaggatctttcaaaggcgagtttggttaggaagataactaaagacaggaaaggtaactgtgtttaaagtcttacaaagcaaattgcaaatattaattctaatattgtcaaaaagaaccattttatattaacttgagcatgattagaaagtatttagaacgtaatgtgtatgttactttccttaacgtaaatgttcctaccctacagttgctgctaggatacatgggactttttccttaatttctttttaatattattcattagtttgcaaactgattagtccataagattcgaaagtgtaaataaagtaaaagtgggtggtgccccattgtttgaagtgtctgatcaggtactgaataagtagaggagttggttccatttgcgcatcctcgggggttgtacggtcatatctgcccagcccgagtgtgtactcatctgaaatggagctagctggttatataagaccctgaatcaaccagcgaggtgactcctctgctgcagattctgctgagaggctgagagtacatgtgggtggacaaggatgacactagtatcactccaaagattaaaaatattcctcttcagacttggagaacctcaggtttcaatccaggattataatcaaggccacctgacaagccgactgagtcaggaacaaatagtgccatacaatttctagacaacagagaggttatctcttccctcaaatccatttcactactgagttatacctgaaatctcattcctggaggaatcattgtttacatgcaggctttgaaaactgatttttaaaaacaaacaaagccaaaaaataaaaacaaaaaacaaaaaaatggaaaagtgaaaaatccaacatttgattgttttctgacattttatgtcttcaatttaatatagatctaattaaatgtatatatattttggtaaggagataggcacagcagagacgggtactgggtaactgtggagagagggaaggaaagagtcaaagaaagcagctgtgtgtgcattgagctaggtgcttccaaaagacatggcctcagttagtcctcacaaaaggcaggcattatgggacctatttatatggtccagaaactggggcctacggatttaagtagtttgactaagttcattctgaaaattagcaatagatcttaatatatccaactaatgcctgtctgactcgaaactccaccatcatttcagtgcctgagactgcatgcaactgggaggtcaagtaggacagagccctggactccatgagcccctctgggtgacttaggctaatggggcatttttttaactggatcaagtctgtgtgggattcttggtgccaatgagcttttaagccgagtggttttcatctccacatggacgtgccacctggggcacacgaagactgcgtggggtgctcctgtgtgtgaagactttgggaggatgagtttcagatcctcagtttccataaaatccatctgcctgaaatagttgaagtgagctccctttcccacatctgaactctaaattccattctcccactctgcaaagtaaaaggctaactctcacccacccctcattttaccatgggatgtttggaggggtaaaaccactgcagcaccaaagaaaggaaactttcaaaatactgatgctagtatcgagagtgaatgatttgcagtgacagaaaataaaaatcttaattacaggtaaattgtttctaagaagtatgatcaagtgagaaaaaattttcagaaaaaaaaataaaggagaatgttctatgggggaagtaaaatgtcaacatgacttcaaagagaaaaaggaactacataagatttctgactttcgaagacttccttcatgtctttttgaaatagatgatattgattaattcaatggatacttttaaaagagttatgtagcagttttattttaaaatgtaattaattagagaacaatggaaataacaccttttgtgactgcttattcttttggatgtcagtcacataaaaattagggtttggaagaaaatattaggctcttaagcaaaaaatattgatgagcactgtcaattctggctgcccttggattgcatgagccacttcactggcatcttttctatcaccaggctagacaggatcaactttgggaaaagagagacaggcaaatatgcaacctcctcagcatgacttttacttacacaatttaaaaggtgtggtggggccaggtgcgatggctcacgtctgtaatactaacactttggaaaactgagtcaggaagatctcttgagcccaggagtttgagaccagcgtgggcaacatagtgaaaccctattgctacaaaaaatacaaaattagctgggcatggtggtgtgcacctgtggtcccagctacctgggaggttgaggtgggaggatcacctgagcctggggagatagaggctctagtgagccataatcatgccactgcggtacagcctgaagcctgggtgacagagtgaaccttgtctcaaaaaaaaaaaaatgctgtgatggagatgtgggagatattctgagtttacaattgcaaggcttatggtccccaagaaacccctagaagaaaacagagagctcgaagttgaatatttaaacttccttctaattaattgtaatatatgtttccacctacagttttcaggagagaatagttgacagttggcataagcaggaatgtaagaaaaaaaaaactcaggtgaatagtgagacaacatggaaacttactgagtttaaactatcaattcctatcccccattctattaccaagtattgtttccagaaaagaaaaaagaaccacttctttttttctctgtctctattaaaaactaattgtgaatgtatgcctttaatacataaaattgttgtaaagcactaatttatgtaaaccctctcaccctgtttttgatcaaatagataatcaagaatttcctttaggaaatcgttctgcagattgaatgaagtgaggttattgctctaagtcatttaaacaatgaaagttgtgtctttgaaatactaatatattcattcttctttcagaatcctatttagaattctgttttttcttcttccaattttttctgaaagctgaaaaaagaacaataatgcaattatgcatgtattgatgtacaactggcacataaacttcactaggatgtaagttggaatgttttcttagaagagcaagtactcagggcataaatgtcagcaattttgaaaaagctattattaattataaggagctcaaggggaaatagttgatattccctatggaaataatagatgcaaagggatgaatgcaaaacaggtttgattctattttgggaaatttaaaaaatatttcacttacagttccaaaagacatataagagtcctttcaaaaactgtgttataagaatttcagcaccatttttcaaagaagacaaacagcacaactgttcacaaggcactaagttcacattcaggccaaatatatttatgacctgaatattccatactcattcatacatttatttattcattcacaaaacatttactgtaaacctactatgttcaaaacaccggagacattgctataaagataaagcccatttagtcacagagaggaacacaaaagtactctcaattaaagagaaataaaataaaatgtataatgcatttttatcattatttctcctgataatcatctctttatgttagacagattataaacatcctacagtgggtgaatctaccttctgaataactatctctcaagtttcttcccaggcactcagaataagatcatatgtttagggaaaattttaaatattccataatgtaacacaatattgaattaaatgtataacatggagctggatgaaaacttttaaattgttaagttgctaggcaaattttagctcttttaacatttaaaaccaccccagaaaatgctcctggtgtattaaactgtcattctgctgacataatccagagtcatatctggctacagttacagcctgtgtaacctggagtgccattgtccaaaattctggtcaggtccgattttgcccacctgaactgaacaagttaaaagtcctccttcttgttatggtaatagtctgaggtttgcgatgaaaccggacttacttccttgattctagtgtattccttgtagagcaagcttgattctattgacaggaagctgatctttccttgtgaaaaggactctgctttcaaatatttcctggctccaatttgagtgttagcctgtaccacacacttctccctgcttggcagaagtagattctaagcattaggtcactcgcttgtcaagctaggttctggaactttgtttgacagtctttagttgaggagaatcctatgcatttgagatgcccttgtggtgtttacgtctttctgaataacatgtttgccaccaataatcaaaacacagcttaccttgcagcagatttttaaaacatacactttgtgatgtatttaatactagccaactattatatgatgggtatctataatcataaacactgaacctaatattctcctgtgaagaaaaactgattcaggagtttaaatcttgagagctctgattgtggaagttgcaggtgagatgatttgtccagtgtgcttatttccaccagctgtgctcagcttataggactttactggggatataatagcctgatgtttggtataaatagattgcaaaggaagacttaatagattttttaagacagagccatcacgcaggacacatctcttgtttttctaacaaggatagcaaatccattttagcacattatctaagttacagctatgggttaattgtacattatagttatttgaaaaagcgactacaaaggaaaatcttgtctaaaatggaattcatagaaggctcttatatagcaactttccagagttcaactacaagcacaaattgtagtgtaaacataatgccctgtgaaatattattttagcccatgccatggcccacttgtttagtgtctttattttaatttccagggtacccctgggattcgtcaggatttattgcaaatgaaaaagaaggatgatctttaatactgctggggtccctcaatagttcatagtatttcatagaagttgattttgcaagataaatctttttgaaaagttgactatcttggaagttgaaatgagagggtaacccagcttcaatacctaaaatgtaaatgagagaagcagttattattagctttggcaaagcagaaatcagggatgtggccatcttgatctagtgcaccaatgtagtgtacatctttctgccttagaggctggtgtccagttaaaaaaatgagttgttttacctgaaatgcagtaactttgcaaaacaagcagcagttttgaaagccaattgatatattttttatcaaatttatctctggtccaagtgctcaagtggtgtttgtggagggagagtagaagtatgttagcacttattctcaataacttttgcagcaatgtgcctgcacaaaacaattttcttcatggcttgatatggtttggctgtgtccccacccaaatctcatctttaattgtagttgccataatcccacattgtgggagaaacctggtgggagtaattgaatcatgggggcggttacccccttgttgctgttctcatgagagtgagtgagttttcatgagatctgatggttttataagggacttttccccctttttctgcacttctccttgctgccaccatgtgaagaaagacatatttgcttcctcgtccacaaggattgtaagttttctgaggcctccccagccctacagaactgtgggtcaatttaacctctgtcctttataagttaccaagtctcgggtatgtctttattggcagcatgaaaacggactaatacagtaacgaaggaaatgctcattgtagcattttggatttttttttattatactttaagttttagggtacatgtgcacaaggtgcaggttagttacatatatatacttgtgccatgttggtgtgctgcacccattaactcttcatttaacattaggtatatctcctaatgctatcccccccctcctcccaccccacaacagtccccactctgtgatgttccccttcctgtgtccatgtgttctcattgttcaattcccacctataagtgagaacatgtggggtttggttttttgtccttgtgatagtttgctgagaatgatggtttccagcttcatccctatctctacaaaggatatgaactcatcattttttatggctgcatagtattccatggtgtatatgtgccacatttttttaatccagtctatcattgttggacatttgggttggttccaagtctttgctattgtgaatagtgccacaataaacatatgtgtgcgtatgtctttatagcagcatgatttataatcctttgggtatatacccagtaatgggatggctgggtcaaatggtatttctagttctagatcctgaggaatcgccacactaacttccacaatggttgaactagattacagtctaaccaacagtgtaagtgttcttatttccccacatcctttccagcacctgttgtttcctgactttttaatgatcgccattctaactggtgtgaaatggtatctcattgtggttttgatttgcatttctctgatggccagtgatgatgagcattttttcatgtgtcttttggctgcataaatgtcttcttttgagaagtgtctgttcatatccttcacccactttttgatgggttgtttgttttttcttgtaaatttgtttgatttcattgtagattctggatattagccctttgtcagataagtggattgcaaaaattttctcccattctgtaggttgcatgttcactcttatagtagtttcttttgccgtgcagaagctctttagtttaattagatcccgtttgtcaattttgacttttgttgccattgcttttgatgttttagacatgaagtccttgcccatgcctatatcctgaatgggtattgcctaggttttcttctagggtttttatggatttaggtctaacatttaagtcttcaatccatcttgaattaatttttgtataaggtgtgaggaagggatccagtttcagctttctacatatggctagccagttttcccagcaccatttattaaatagggaatcctttccccattgcttgtttttctcaggtttgtcaaagatcagatggctgtagatatgtggcattatttctgagggctctgttctgttccattcatctatatctctgttttggtaccagcaccatgctgttttggttactgtagccttgtaacatagtttgaagtcaggtagtgtgaatgcctccagctttgttcttttggcttaggattgacttggcaatgtggactcttttttggttccatgtgaactttaaagttgttttttccaattctgtgaagaaagtcattggtagcttgatgggcatggcattgaatctataaattaccttgggcagtacggccattttcacgatattgattcttcctacccatgagcatggaatattcttccatttgtttgtatcctcttgtatttcattgagcagtggtttgtagttctccttgaagaggtccttcacgtctcttgtaagttggattcctaggtattttattctctttgaagcaattgtgaatgggaatttactcatgatttggctctctgtttgtctgttatgggtgtataagaatgcttgtgattttttgcacattgattttgtatcctgtgactttgctgaagttgcctatcagcttaaggagattttgggctgagaagatggggttttctagatatgcaatcatgtcatctgcaaacagggacaatttgacttcctcttttcctaattgaataccctttatttcctctcctgcctgattgccctggccagaacgtccagcacgtcccatgttgtccaacgtcctatgttgaataggagtggtgagagggcatccctgtcttgtgccagctttcaaagggaatgcttccagtttttgcccattcagtatgatattggctgtgggtttgtcatagatacctcttattattttgagatacatcccatcaatacctaatttattgagagtttttagcaatgaaggttgttgaagttgtcaaaggccttttcttcatctattgagataatcatgtggtttttgtcattggttctctattgagataatcatgtggtttttgtcattggttctgtttatatgctgtattacgtttattgatttgcatatgttgaaccagacttgcatcccagggttgaagcccacttgatcatggtggataagctttttgatgttctgctggattcggtttgccagtattttattgaggatttttgcatcgatattcatcagggatgttggtctaaaattctctttttttgttgtgtctctgccaggctttggtatcaggatgatgctggcctcataaaatgagttagggaggattccctctttttctattgattggaatagtttcagagggaatggtaccagctcctccttgtacctctggtagaattcggctgtgaatccatctggtcctggactttttttggttggtaagctattaattattgcttcaatttcagagcctgttattggtctattcagagattcagcttcttcctggtttagtcttgggagggtgtatgtgtcaaggaatttatccatttcttctagattttctagtttatttgtgtagagatgtttatagtattctctgatggtagtttctatttctgtgggatcagtggtgatatcccctttatcattttttattgcgtctattttattcttctcttttcttctttattagtcttgctagtggtctatcaattttgttgatcttttcaaaaaacccgctgctggattcattgattttttgaagggttttttgtgtctctgttttcttcatttctgctctgatcttagttatttcttgccttctggtagcttttgaatgtgtttgctcttgtttctctagttcttttaattgtgatgttagggtctcaattttagatctttcctgctttctcttgtgggcatttagtgctataaatttccctctacacactgctttatatgtgtcccagagattctggtatgttgtgtctttgttctcgttggtttcaaagaacatatttatttctgccttcatttcgttttgtacccagtagtcattcaggagcaggttgttcagtttccatgtagttgagcggttttgagtgagtttctgaatcctgagttctagtttgattgcactgtggtctaagagacaatttattataatttctgttctttcacatttgctgaggagtgctttacttccaactatgtggccaattttggaataagtgcagtgtggtgctgagaagaatgtatattctgttgattttgggtggagagttctgtagatgtctattaggtctgcttggtgctgagctgagttcaattcctggatatccttgttaactttctgtctcgttgatctgtctaatgttgacagtggggtgttaaagtctcccattattattgtgtggtagtctaagtctctttgtaggtctctaaggacttgctttatgaatctgggtgctcctgtattgggtgcatatatatttaggatagttagctcttcttgttgaattgatccctttaccattatgtaatggccttctttgtctcttttgatctttgttgatttaaagtctgttttgtcagagactaggattgcaacccctgcctttttttgttttccatttgcttggtagatcttcctccatccctttattttgagcctacgtgtgtctctgcatgtgagatgggtttcctgaatacagcgcactgatggggcctgactctttatccaatttgccagtctgtgtcatctgattggagcatttagcccatttacatttaaggataatattgttatgtgtgtatttgatcctgtcattatgatgttagctggttattttgctcgttagttgatgcagtttcttcctagcctcgatggtctttacaatttggcatgtttttgcagtggctggtaccggttgttcctttccatgtttagtgcttccttcaggagctcttttagggcaggcctggtggtgacaaaatctctcagcatttgcttttctgtaaaggattttatttctctttcacttatgaagcttagtttgactggatatgaaattctggattgaaaattcttttctttaagaatgttaaatattggcccccactctcttctggcttgtagagtttctgccaagagatcagctgttagtctgatgggcttccctttgtgggtatcccgacctttctctctgtttgcccttaacattttttccttcatttcaactttcgtgaatctgacaattatgtgtcttggaattgctcttctcaaggagtatccttgtggcattctctgtgtttcctgagtttgaatgttggcctgccttgctagattggggaagttctcctggataatatcctgcagagtgttttccaacttgtttccattctccctgtcactttcaggtacaccaatctgatgtagatttggtctttttacatagtcccatatttcttagaggctttgttcatttctttttattcttttttctctaaatttctcttctcacttcatttcatttatttgatcttccatcactgatacacttttttccagttgatcaaatcagctactgaggcttgtgcatttgtcacgtacttctcatgccatggtttcaagctccatcaggtcctttaaggacttctctgcattggttattctagttagccattcatctaattttttttcaaagtttttaacttctttgccatgggttcgaacttcctcctttagctcagagaagtttgatcatctgaagccttctctcaacttgtcaaagtcattctccgtccagctttgttccattgctggtgaggagctgcgttgctttgcaggaggaaaggtgctctgatttttagagtttccagcttttctgctctgtttcttccccatctttgtggtttatctacctttggtctttgatgatggtgacgtacagatggagttttggtgtggatgtcctttctgtttgttagttttccttctaacagtcaggaccttcagctgcaggtctgttggattttgctggaagtccactccagaccctgtttgcctgggtatcagcagcggaggctgcagaacagcagatattggtgaacagcaaatgttgctgcctgattgttcctctgtaagttttgtctcagaggagtacctggctgtgtgaggtgtcagtctgcccctactggggggtgcctcccagttaggctactcagggatcagggacccacttgaggaggcagtctgtccattctcagatctccagctgcgtgctgggagaaccactactctcttcaaagctgtcagacagggacatttaagtctgcagagatttctactgcgttttgtttggttatgccctgcccccagaggtggagtctacagaggcaggcagacctccttgagctgcggtgggctctaccgagttccagcttccaggccactttgtttacctactcaagcctcggcaatggccgacacccctcccccagcctcgctgccgccttgcagttggatctcagactgcgtgctagaaatgagtgaggctctgtgggcgtaggaccctccgagccaggcataggttatcatctcctggtatgctgtttgctaagaccattggaaaagtgcagtattagggtgggagtgacccgattttgcaggtgccatctgtcacccctttctttgactaggaaagggaattccgtgaccctttgtgtttcctgggtgaggcaatgccttgccctggttcggctcacgctcggtgcactgtacccactgtcctgcacccactttccaacactccccagtgagatgaacccagtacctcagttggaaatgtagaaatcacccgtcttctgtgtcgctcacactgggagctgtagactggagctgttgctattcagcatcttggctccaccccaggattttggatttttggatttgggatgttaaactggtaagtatataatgcagtattccaaaataaaatataatttaaaatccaaaatgcttctggttccaagcatttcagataagggatactcaacctgtattggaaaaccatgttaaatgggcatcttcatacagttgctaaataaatactatgtgagggacctattctaagttgtaaagatcttgtaaaagtgaaaaaggaagttgcttaagctatttaaattggatcatgctacagatggggacaaaacatttgctgacaaacaaacaaaaacactccaaaacgtaactgataaagggctagtatccaacatatatgatgactctgaaaactcaacaatgggaaaaagatgtgaacaggtttctcaccagagaagatgcacagatcgctaataaacataggaaaatatgctccatatcatatgtcatccacatcataactcatcaggataatgcaaattaaaacaaagagatatcattgtatgcttattagaatggctaaattcaaaacactgacagcatccaatgctggagaaaatatgggacagcaggaactctcatccattgctggtgggaatgcaaaatggtagaggcattttggaagacagtttggcagtttcttataaatctaaacatgctcttatcttatgactcagcaattacatgccttggtatttaccccaattacatgaaaacttatagtcacacaataacctacacccaaatgtctacaacagctttgctcataattgccaaaacttagaagcaacaaagatgtcctttacagagatactctctaaaagaaaatgatatttattcaggagtaatattacaatgggattatgcacgccatagttaactatgtgtgtagtcaaaaatattgaggcacgggaaagtttttaaagacaaaatgaggtggattacataagttattttgaatcaattatccttggaaacaagaataaataacaagaatgctgtgagtccaaggttggacaggcagttgctgaacaggtgtcctcgcagaagtattttctgtgtaaagctgtggtggcctttgtgtaaagttgtggattttgccatcttttgtggtagttcttattatcagggatatgtgcatgagaaccctcccccagtggctttccctctctccatttgtcaatgcttgacacaagtgcctccatttagactctgaaaactttcacaccttcagtaggtgaatgaatcaactgtgatacatccagacaatgaaatattattgaccaatacaaagatatgagttatcaagccataaaaagacatggtgaaaccttaagagcatattgctaaattaaataagctaatctgaaaaggctacaaactgaataattccaaatatatgacattctggaaaagacaaattaggggcacaataaaacgattagtggttttaagggattttggggtacagagggagggagagagggaaggacgaatagctgaagcacaacagatttttagcacaatgaaatgattctgtatgatattgtaatgatgggcacttacctttgtcagaacccatagaatgcccaccaagaatgaaccctaatataaactatggactttaattaacaataatgtatcaatatagactcaacaattgtaataaatgtaccacaatgttgctaaatcttaataagagtgtaatctgaggatccaggggaggtgaagggagaggatatataggaactctgtactttctggtcatatttctgtaaatgtaaaacttatttaaaaagagtattgaaaaagaaagaacataaatctttattaaataggctctgcagggtccctaaatagaaactttttaataatgattacgacctaaaaatatgtttataagtaataaaattacattaataaaatcattttattacatagtctacttctctcacactaatttcaactgacctttctaccaataattcaaaaccaagattgatttcattttaaggcacaaacaatggattgaattaataagatgcatattagaaatgggttgttttatcaattcttatgtaatgcatattttgtcaggaaatattcattacaagagagagctaaaacatgaggcaccagtcttttgaaattcccttaagttaaacaaaaattgccaggaaaagcagaaagaactatattccagaaaagttaacagaacaaggtacatttaaaccattttaactgctcactagtaagagcagtgggatctttgaagaataagtagttaataagtcacagtatcctacccgtgagaatgaaatgtaactttctattttgctaatggttcaaaatagcaaattggctattctctctctcggctgcaagcttgaaaatcttgaacatttgtgtttttactacttagaaaaagaaagatgcaatataaagagaatgtcatcctgcagtgtttcttcttcccaaagccaataattattttcaaatacatttttatttcaatactttttggggtacatgtggtttgggagtacatggataagttatttagtggtgatttctgagatttttgtgcacctgtcacccaaaccatgtacactgtatccaataggtagtcttttatcccttacccagctcccaaccttcaccctgagtccccaaagtccattatatcattcttatgcctttgcatcctcatagcttaacttccatgtagaagtaatagcacacaatatttggtttaccattcctgaattacttcacttagagtaatgtcctccagctccatccacattgctacaagagacattatttcattcctttttatagctgagtggtattccatggtgtatatgtatcacattttctttaatcattcattggttagatgggcacttaggttggttccatatttttgcaattgtgaattgtgctgctataaacatgcatgtccatgtgtcctttacatgtaatggcttcttttcctttaggtagatacctagcagtgagattgctggattgaatggtatttctacttttagttctttaaggaatctccaaactgttttccacagtgtttgtactagtttacattcccacatgcagtgtaaaaatgttcccttttctccacatccatgccaacatctgttgttttttgactttttaattatggtcattcttacaggaataaggtggtatcttatgatggtttcaatttgcatttaatttgcattttgcattttcttgtttgtttgaaattcaagtaactttaataattggtgatgtttagcattttttcgtgtttgttggctgtttgtatatctttttttgagaattgtctattcatgtcctttgtctgtattttgaagggattatttgtttgagtttcttgtagattctggatattagtcttttgtgggatgcgtggtttgcaaaaattctttcccactctgtgggtagtctgtttactctattgattatttattttgctgtgaaatagctttttagtttaattagtttaattagctcccatttattagttttattaattttgttacatttattattaattttgctatatttatttttgttacatttattgaaataaagataaaaatgtatttaaaaataattattggctttggaaagaagaaacactgcaggatgacattctttttatattgcatcttttttttctaagtcagtgaaagacacaaatatccaagagtggtaaggctattcaatgaggaaaggtcagtcctcaaaaaatggtgctgggtaactggatatctacatggtaatgaatgaatctggacccttactgtacatttgttacttataattttgttacattcgttacattttgccttactggacatttgttacttatgattttgttacatttctggaaaagtttttccgatgttatcttctagaatgtttatgatttaaggtcttaaagtctttgatccatcttgattgatttctgtataagctgagagatgaggatccagtttcattcttctacatgtgcaaagctcactattaaattattatttaataattattaattattaaaatatgtagaatataatgggtattttcaacttccctatgaaaataaattcagatgaagttggttcaaaaaactaaatgtatgtaccttttatatcttgagaaatatcactggcacattattcatactgtcagtgggcatttcagtttccaccttttggctattgtgaataacgctgccatgaacatgagtatacaaatatctgtttgagccactactttcaattcttttgggtataaactcagaagtggaattgctgggtcatatggtaattctatgtttatttcttttttgaggaactgcaatactgatttacacagtgtcctgcatcattttacgttgccgccgacagggaataaagatgctaatttgttcacatccttgccaacacttgctattttctgtttttgttttgttttgtttttgttttttgatagtagccaacctaatggtgatatctcattatggttttgatttgcattttcctaatgattagtgatggtaaaaaatcttttcatgtgcttattggccattcgtatgtcttttgtggagaaatgttgttttaagtcctttgccaatttttgaaacagattttttgttgttgctgttgagtttaggagttctctacatattttgggtattaacctctcatcagatatatgatttgtaaatactttgtcccattccgtggattgcctttatactctgttaatatagttctttgatacacaaaagctttaagtttccatgaagtgcaatttgtttgttttttcttttgtcacgtgtgtctttagtgtcatattcaagaagtaatttccaaatctgatgttgtgaagattttgctctatgttttcttctaagaatttcataggttagctgtaacatttaggtctttgatctgcttttagctaatttttgtatatggcattaagtaagggtccagattcattcattaccatgtggatatccagttccccagcaccattttttgaggactggcctttccccattgaatagccttaccactcttttcaacaatgtttgaccacatatatgaaaaattccattgatctttacatctgcttttatgccaaatgcactgttttgattaccatagctttgtagtaagttttgaaatcaggaaatgtacatcctctagctttgttctttttttatcgcgattgtttcggctacttcatgcccctgagattccatatgaattttaatttctatttctattaaaaagtcattgagattttgataggaattgcattgaatctatagatcatttgcgggggggattgttgacattttaatattgtcttccaattcatgaacatgggatctctttccatttacttatatcttttaaaattatttttagcaatgttttagagttttcattgcagaggaatcttttaaaaatgtaactattttaaagccattcatggggctttttcttactggtttgatccaactttgcattgcatactgatccatatattatgccaacttattccatttatagactgaaaaatgtatatcaattttgtacctgtgggttaaaacttcattagaacagttaaatgacatttaatgtagtacagctggaaaacaatgccagtgcacaaatctattactataataatgtggttttgaattacatttcacacagctcagtattatcttctaccaaatttacaagtccaatgaaaggtaatatagttcaatatacattaacaattatggttcttgttttcttacttaacggacctgctatttcaggtattgttttcatttaccttttaatcagcttaaatgttgtaaaatacctataatgagaggggtcgtattacaaggaaagcatgagaaactgtgggtagcaaaatttgtttggttagttttttttctagttgtaaagagatgatgttgatattatctcatagagatttcctgttttctcagtcttctgggaagacagaaccatatgccactaaaccaatcctcattgcaccagatgtcttatgtaaaggaacaccttaacatctcagagattatacatttttaggaatcaaatatgttaaaaggattaaaaaagatattttacctctctacattctccagagtaattagcccagaactttgcataaatgtgtttactttgtattcatttctttatttagtaattcattctcaaatatttgtttagtaccttatatgggctaattgcactgctgtgcattggtggttgtgggattcagccttcaagataccacccaatgatccctgtctcctgctacacacccttgggctacgttgcaccagggttggtctgtgggatccatagaatattgcagaattgatggtatgttacttccaagataggtagtaaaagatcgacttccatcttttgcattaccttttttgggtcaccctctctggggaatccatgtcatcagcagctttgtgaagtgtcccaggaggtgaggatctaaagccttctgccaacagccatggaagtgagctgagaagtatatcttctcagcccagtcaagtttcaagttactgcagaccctgctgacactctaattgcagcctcatcagtggccttgagccagcaccaccaagaatagctgctctagaattccaaactctcagaaactgtgagaaaataagtgtttactcttttaccctgaaaaatttgaaagacttttctatacagcaatcattaattaatacagagatacatgcatgaacaagtcttttcttaatttcaatttttatcatggattaaagggtacatgtgcaggtttgttacatggataaattgtgtgatgctgaggtgtggggtaccaatgatcccatcacccattccggaagaatcgtacccaacaggagtttcttcagcttacattccgctccttttctcctccagtgatccccagtgtttatcattcccatctttgcaatcatgtgtattcaatgtttagtttccacttataagtgagaacatgtggcagttggttttctgttcctgtattagtcgcttaggataatagcctccagctccatcagtggtactgcaaagggcatgattttgttcttttttatggctgcatgatattccattgtgtatatgtaccatattttctttatctagtccactgttgatggacacttaggttgatttcacgtccttactattgttaatagcactgcagtgaacatacaggtgcctgtgtctttatgagagaatgaattattttcctttgagtatatacccagtcatgggattgctgggtcaaatagtagtactattttaagtggatgaacgattcttgtcctgccttcaaggagctactagctcagtgaaactggtgaactgttgatttaccactaaaccaagggtagataccacgacagcacctagatgcagcacctatctcagtcttggtgacaagaacagccaaatgaatgaaagattcttaatttgtggctccaagaatgaggacgaggaagtagcaagagaaaagcatggacgattccagatagaagagaaagggtgagccaaggttgaggttagggagaggtgagtacagtagtttccaggccctggtttcatgtgggcaacaggggtgatgaataatgaggatgggggggtgagctgggaacagatgaggaagaaaagtatatatcacaggaaggagttagaggagagccactgaagatttttaagcacaaacatgactaccattcagagtataagccagggtacgtaggaaacaaggaggcactggctgcagaaacaggaaaaggtcctgggagtctaagagagggtagtggcagtaggaaagagagggagttgagtttgaggcatgttaagaggttagaatcgacagatttgaggctgaaatacataatttggcatttttgtcttttaatttaccccactaagacccctggacacttaacccatacctgcccctcctctagtacggccatcttggtgattgacaccacagatcactcagtcgctccagatggcaacctggacatgactggaaatacctccctttcccttgtaactgtatccagttactaacctaattttacatatctaatgcccaagatctttctaattagagtgtcccttcccttctttccccacctgagtagtgttaagtaaacccttgccacctcttccctcaatttttgtaatggttcctaacagtttcactcctagccataccttctttgcatgaattctctgtatccctaccaggcccattcaaaacactcatatgagtgttcacccaccctgcttagacacattcactggttcttctgccactgtggacacagtccacatgctttggcttggatgcaaatcatttttctctaatctctagacttctctctctctctctttctctctctctctatatatatgtatgtatctcccttcctccctcctcttctacctcctcctcctctctctctctctctgtctctctctctctccatatatatatatgtatatatgtatgtatatcccttcctccctcctcttccaccccctcttcctcccccccaaagccctattgtatagccatattaaactactggggtcacttatgtacatttaaaccctttcttttctctatatggatcttcactccctcctgtccccagctaactcctacatgttaggagttagaactcatacatgttaagacccaactgtgtgttgcctcttcttggatacataagctgccacctgatgcctatctcccctagctctcacctcactatattcaatttgtgatttgcatccagtctctcccacaagtttccaaactccttgaaggcagggaccacacctcatgtgcctggcaccgtcagcgtagtgtcttgcataaaatagacactccacaaatgtgaaaagctagaactgagcactgcattcaaacattctgcttagtgtcctgaacaatacagtccaaacaggaaagtactgaacattaagaacctttttatcttctttaagagttagaaaagcttgaataattctttcttatctggtataggaaaatttttgattttttatattagatacactggaaagtgaactatcaagcatgaagagacaaacatctactatttgaacttttgacaactaatttatagctccaggaccaataggttattacgtatgttgtccttgtttgtgcaagaccaatcaaataccgctttgtattaatacttttaaaaagattaaaattctgtttttttcatgtttaactctgtcttcagatatgagtcacctaatgtcttctttgagaggagattactttgaagtctgggggacatccccagctagaagacctgggcagaaatatgctcggatgatcatgatctgaattcaaagggaacaattaaggaattatttccattttgattctaatagcaagcttttctacttgttgcccttcaacctgtctgcatgccagctgaaacttcaatagagcctcatgacagagctgttaaaagactttgaaaagggaacgtgtgaaatcataaatgcttcagaaataagataatgtttctcagtccattacattcttaacctcttgtttctgcttaacggacttcgttaaaggtcagtgagaatgttttaacagcaaatgcttgagacttccaagaacatattgccattctagatatccattgctaataaagaactggtttggtatattctgtacttatattttcagtaaaaataaaaagtcatcatcagaaagacttgagcataaatctaaatttcaaatctttgaattagtatatatttgaaaatttgtaatctggtgttacttttccaattaggaaaatgaataacataacatctttataatgcattacagtttatgatgaaaatttctgtatgcttttctcatttttcactatagtggttgagtgacatggataataatgtaatttcattttagatatgaggagactgcagtccgagaaggttaggttgcttaactaaccctgctaacctgtgaatgagctgtgatgtgatcctagatttgcaatcacaaactgacaaaattctgttctctattgaatgcttctgtttttgtttttatttgtttctaagaagttttcgaccaggcactgtggctcacacttacagtctcagcacttccgtcaagaagccaagataggcagatcacttgagcccaggagttcaagaccagcctgggcaccatgccgaaaccccatctctacaaaaaatacaaaacttagctaggcattttggcatggcctgtagtcccagctacttgggagaatgaggttgcggcgacagtgagttgtgtttgtgccactgcactctagcctggcagacacaatgagactctgtgtcaaaaacaaaaccaacaaaaaacagttgtttttccagcacaattcatgagattgttttttaaaatgcacaaactagtactttaaaagatatttttgattttccattacacaagtacagaaatgtgtaatttctctatcaacttttcccttaagaaattaatttttttcattgtctgaaagagatagagttacctgtctctaaaggatattttcctcaagtacccacaggtaattttgaatttgtggttcatttcacctttttatgactccagaagttaaatgattcttggctgtacatcaaaagatgattatgtagttattatttatttttatagctcagatgaacctggtactagcttcattatagtgcatgtcccatcggccaaatgaacacaatctggaaatatgacatgcatttttaatagtaatagggcaataattctgcattttgtgtaggtgtaccaggggctacttaagtgaggtttaatgtcaattaagaaacactgcagtgcccttactggaatcttgtaatagtcacatttctctcgttgttttatgaagtcaggtgtaaataatcactttagagggagacttactaagtatggacctgtgcatcatttttcttagctatatatatgaacgtatagtaaacataagcagcacaaacttttcttctgtttctagagtgacaggcattctgtagtattgataggatataaatagacatcattaaatgctttacccatggctttgggccctagtatcattatctgaaagcatttagaatgagtaactaaaagccaagaaaatttacaagtcgcattttggagaataattacagttatccatcaccaaactgctggcaagtagtggcattgcctcattggattttatccctttttatgactctggctgttcctcaggtgtaaggtctataagccatcaagtggattggaagggccaggaagaccagaggcgcagaatgacttcaagaaacagcatataaaagagtattggcacaatatggagaagcagctgaaatatttggaatttgtatgtgctgagccgtgtgaagattgctactcagtattaatcacattccaaaagataggttatcattagcatttataataacatgtaagttctactctgtgctacctgatgtaggagactttattagttactcatggctgcaggaacaaggtccacaaatcaagttgcttaaaacaacagatatttattcacttacagttcttggagctagaagtccagaatcaagatgtcggcagagccatgctctagggaaagattccttctttgtttctggtggttgtcagtaatccttggcattccttggcttgtagatgcatcactccaatctctacctctatctttacatggcctttacctggtaggactaggtcgaaacttcccacactatataaggacaccagtccttgcattagaacctcccataatccagtaagactttaccttaacttggttgcatctgcaaagaccctttgtccaattcaacaaagaccatacgtttcctaactcaatggctttggaagttagtgatattgaaaatataaatgtgtatttttagaaccagtatgaaacatgtgtttattatctattgctacataacaaatcaccccaaaacttagtgccttaaaacaacagccgttttgttatatatcaggattctgtgggtcaaaatttggatggggtttggctgggcaattctccatgtggcatccctggtggtatccagttaatggcttggctggaaagtgaaaaatggttttgttcatagctagaaggctgggcttgacttaatctctctcattctccctgtgtgctcaggacctttccacacactctctctagcagagtaactgtatatcttaaatgacagttcaaggttttaagagtaagtaattaaagagacaggaactgaaaactgcttgtcattaataagggacaggcccccaaactggcacagcatagcttccataatactgtttgtcattatagtcagagcataccttcagatttaaggggagaggtgtaactctctgtggaaagactattgttcaccttttggccacagatagcttacatttctcccatctttgaaaatctcatgccagcagggcacagtggctcaagcctgtaattccagcattttgggaggctgaggcagatggatcacttgaggtcagaccagcctggccaaaatggtgaaactccatctttattaaaaatacaaaaattagctgggtgtggtgactcatgcctgttattacagctacttgggaggctgagatgagagaactgcttgaactcgggaggtggaggttgcagtgagccaagatcattgtgccactgcactccagcctgggtgacggagtaagtgagactctgtctcaaaaaaaaaaaaaaaaaaagaaagaaagaaagaaaagaaaatcttattccatcagagccctgccttgaatttaagaagccgctggtaaaatcagttctatgtagagatgagattctttgtgtatattttctctccatctgaagacctgtagaccataggaacaaattttgtgccctccccacaacatataatggtcagagaggagtagattctcctctttaaaaaagaaaatgggaaacatgttccacagtaattctaaaatccaaccagatgcaggtcactagatccttaactaggctctagtcctgtttcctggaaactattgccctggctctccgtttctctcttgaatccatcctccttttccataaaaactttatgggacccctgtgtatcaaataatgatccaatccatcagagaaaagccatgtacacatttggttctgacatagtccttttttgctggaacttagggcattctggggaaatgaaaagaagccttctttctagttgaaagggttcatcaggcatccttaaaattcacagagacatatattatgatttctataagtccaattaggcttaccttcagatatttctgagaggtcaacaaaggaacatccatgagctttattttcctaaaaccatattgtacaagtagcagcagcctggatttaatctttgccctgaggtcatttgtaactttgcaagtctattgctgggagagcctgggaatgagaaacaattttaccttcatattcagcatgttctggtccttttttcctctgaatcttgcttagaaacagaaaatttcttctttggcttatccctttccatgttttaccataggcagctaggaaccagttggcgctttctccattttgcctgttcatctttcttgccagacttttgtggatgtccattaagtttcttatcacgtgcaacattaatgccaaactttctgccagtacagaaaaagtatcacatattttctggcctccagtaacatattttcattgtctctaaaggcttcaccaacagtcttttcaaggcccttggggcttttgctaacagtctccttgaagtcctcttctttccactaacagtctctatgaggcccttctagcttctgtccactgcttgattccaaagctgtccacacatgtgacaggttttgtacagcaacaccacacccccaggtaatggattttgtcccggttttctactgttgtgtaaaaattgaccctaaaacaagtggcttgaaacaagcaccattttattataccttatgacttttgtagactaaaaaacagcctgagcttgactgagagttccttctgctccatgtgatgccacttgtagtcattcagaggtggctgggatggtccacaaccgaagtcagcaaagttttttggtgaagggccagaaggtatgtattttaggctttgtgggctgtactgtttgtcaaagctactcagcctgaccactgaatgacaaagtcatgtggttgctcagtctgctagtacctggtctagagaacccaagaaggctaacacatttcatttactttcatgcagatggctagagagtgggctcagcccatcttctctccctccctcggtagttgcagggtgtctctgcatggtttctccagcaaaacagtccactttctcacatggacgcttaggccccaagaatcagtggtccaacaaacagaaagtgaaagctgccagcctcatgaggtgtaggcctagaaatgcacaacatatcatttctgccattttcactggtcaatgcaatcatagatcccttcctcccatattgaaaaggaagagagagaaatccttactggatattttgcccggaaatggtatcagataacttgtggccattcaacacaatgatcaccttagttcactgatgaataagacatttctctaccttcgaggagcttacattataattggaaacagatatgaaagcaattttctggagcataggacagaatgaagtatatcaggggcaggaaaaaaaaacatataggcactcctataaggagtgtcatgaatttgaatatatgcctgtgttttacaagtagttgctagcccttgtttctgtctattttactgtcaagtatagtacatatatatataacacaacacacataacagacacacactctcacacacatatgtgtgtacacatatacaaacaacactcacacatgcacagcacgtgcacacaccaactcacacatgaactttcaaacatgtaactgaaacaagtttcttcacatagcagttactgtaagtctcggcaatgtacttggttatattcctttctttctattatatttaatttttagaaattctgatcattgtccactgaattaatttcacaactgcagtttatttcataaactgaagtgtgaaaaacaactggtcaagaagatgcggaggtcaacaagccttgtgagtcgctgttgcacaataagttattgttaaaatttattctttacaggaagatctgggaattgatttaacaaggggataggaaaaaacttttcacaaatttctttctcagtggcttctttgatagaatatatgtccagtatattttgatatatgttatttattatctgccaatgatgtgtctgtttattttgagctgctttggtaacacattagtttgaagtagccataaaaccttttaaactgtgataggttgtgaaaataccattaggtccttgtagaagttatcatatttcatgatgtgaaaagtttataatttttctcgtttgtttagaaactatattcatgttgatgacttgaaaaagaaaaaaatgggaaataattataaaataaattatactataccattaatatacaattataaaataagagtcattctttagttttccagtaaatgagtatttacttagttttgaaatgcaacagtgaacaggacaacacaaatcttccattatggaacttatgttctgcaaggtcaaatagaagaaaacaagtcaacagccaaatgaagtaattgtgagttgtgatgaatgccatgaaaggattaaacatgagctgaaatagaaaattttaaggtcagctcttatattagggttatctagagggacagaactaataggatagatataggtatatatatagagagaggggagtttattaagtattaactcacgtgatcacaagatcccacaataggccatctgcaagctgaggagcaaagaaagccagtccgagtcccaaagctgaagaacttggagtccaatattccagggcaggaagggtccagcaagggagaaagatgtaggctgggagactaggtcagtctagtcttttaatgttttactgcctgctttatattctagccaggctggtagctgactagatggtgctcagccaaattaagggtggatctgccttccccagcccactgactcaaatgttaatctcttttggcaacaccctcatagacacacccaggatcaatcctttgcatccttcaatccaatcaagttcatactcagtattaaccatcacagctcttgacacagggtggtcagagagaggctctctgctctgagtagttggcattaagaagaatctaaagaataagaaggagatgcctgtgattagaccactaggaagaatgttccagatggtgggtaaaacataatgcagaagctctggggtcaggatgaggttgctttgtttgggcaactgaaaccccagaatgagtgatacctagggagtgagttaagtgagagattgtctgagatgagagagaaaggtagacaggaactgatctcacagggcctactaggccatagtaaggcgtttagagtttctttccttagccagataggaagctattcaagtgtctttgcaggagagggcaaggtctaatttatattttaagaagctcagtctgactgctgcttggagattgaaccagagtggaacaaaagtggaagtggggtgtacactgggcttattccttttgaacgtccggggataaaagttcagcttctacactgactatttcctgtggaatttttggttcttgtaagttaaattgaacatagaaatatggagacaccttaaatttaaattaaaaaggcaagggttctatttagttttgtctaaactatcctgtaaatagcaatttgcaaaatgagattcatctttttctttaaaaacttgtagattcctttaaatttaattctgatttcctcttgaaaatggtaataattcctaagaggcgtcagaaatcaccatgtgtttatttacatgctctgtaccccaagttaaaaagtaatgtgcatatttttctaaagaaaggattttataatgtaagaacggtgggctgattgttaaagaaaaaaaatctaacatttgctgaaatggtaaggaagactttattcaggactattgtgataggtgtcaaaactatcagaattgaggagagaaatgggtctcaactgcaaatacatgcaaggacaagtagggatttatatcattaggacaaataggtttaataccttttcctcacccatcacaagggtctagctgacactgatatgggaaaagacagattaataagaaaagagtataacaaatttatttaacaaagttttatgttacatagaagcctgcaggaaaactgtatttttatgttttttaatgtattttttatgtttaggtttgatgaagaatagtcatgtagaaatataattggacaaaaagcatatgatgtaatgatataaacctaaggcaggggaaggcagccaggactatttattccaattcttcttggcctctctttttataattttttcctcctgggtatggggcaggtcacctatcaaatgagggtcttcaagggagaaaggagttcagagagtgacatttctaggttttatggcttgctttgggggagaggagttctagtttctattacctgctttggggaaaaggaattctagtttttatggcctgctttgtgggtgaaataggagaaggagaaaggagggcagaagaaggtcagagagaacttcctgcttttgaggccctgccaatccctttcagaagttcaaagtcctcagcctgccaaagcactgtactttggagtatgatgctctgagctgcagtaatggccaaaaagcaggtttggatgtgatagtggatggaaaattcagaagccaggacatcaagggtagggggaatcttgctaaactgacataataggattcctgctgagggcaggctagggtgatcagatattaaggatgggaggattccctgtaaacttaggagcattcttgctgaaacttggctacgcaggcttcccacagatggtggtttgctcggaggcaaggttgaggcattgtcaggaagagggcttaggggagcctaatgaaagtttggtcaaggaaagcgtcttgtcatcttcattcattcttcaaaacagacatgagatacagctgctacaaaacaacaccgattaatagttgtattttatgtgctgcccattaaagtacttacatttttatttttccagaaattttaactacatgcttcagtgttattagattacccttggaaacactcagctacagcaagtgttttgtgctgtttattttagaattcatgggacagctcactttctagccattaatttgagctttcaaagacaagttacacaagtgacaatggggaatttgatctatttgtgtatgtaattatgagttcaacaggcattgttttcaggtactgtgatagaccctttctcttacttaaagcatgtgatttggttcaaaagacatttatgatgttaattttataaaaaatcaagaaggtgatatgagttcccatactgttggcatctgagcttggatgacatgttaacgataacagttagtctagatgaaattcattctagaaataatacaccttgtgagttagaagcaaccttgaagtgcatgtaatcaaaatcccctattttactgactgagaggcaagagaggtcacattgctacttggtgactctttctgtcaagttagagcatcaaaagcaatttacttgaactacagtggattaactctccaaagaaattacctttgttcaaatatgattcaataaaatgcctttaacctttattcagagctgctgcattttttcaggatgaagagtcaaacctgatgtctttttgtatgaagatccacaggaaaaaaattcttttgcaatttaatgccagaaaaaaaaacaaaacaagcagaaactacatctcttgtgaataattggcaggctttcttttgacaacatgagacccatgaggttcattgtgtttctctttttcactttgtgtccaggacctgcggagttagatgacaaaggctaaggaaattttctccctttttactctatgctgtttcttgtttcccatttaacttttctctgtgcttttgtatgtaaatttttattgcaagccaccccacaaatgctttttgaaagctaataaactataaattattcaggaataaatattaagtgacaaagacaaaactctaatccagatcttctatctcccagtgtaaatttcaatccattctatcatgattggaaaggcattaatatctctgacaattcctttctcaatagaaaaaaatgtttccaatatttgtgcaaaagggagatataaaagaggtgtcttattccctctataactttggctcaaattttaaaacttaagaattgcacccctcaaccactgaaccaaaaaaaaaaaaaaagagatagaaaataaaataaaaggaaaagaagaaaagaaaatctttctttttgtttggttgctttggaaatttggaagtatattattttattggcactcagagctgtgcagagtcctgatggaaatgtctatatagtcacagtgaagcctggaacaggcttgggtatccttttgaatacagattatatgtacaaagaccaatgcaatagaaaccttttaaatcaagcttttcctctgtaacaaaagtgtctagtctcttgattcctgaatccattaatgccctttgagtgtcacccagttacatactgctgggcatcaggttgcctttccagtgtggaagcctgagactcctgcacaaaggaactcttagggctcttgatgtttctcatcttgtgacactgaattacagggcttctcttttattgaagtgctgactggaagaagggttatcacagcagccccagccagtgtggcacagctgcccacactctttgtaatgttctttgaaaagaatgtattaataatgtccaaagttgggtcaggctgtcagtcacagaaataattactcttgagaggttaagattcactttcttaaaatcaagtgggagtcatggtagatattagaagaatggagcaaagcacactttaatataactatcaatgtgccaacaatagacatttgggggaggaactgggaatatcatacttacaggaagcatgtctgatgagaactcagagagtggaaaatacaagtatgggatattattttggatttctagctattacatatcatctttcctttttcatcattattattattgcagactaaaaccaaatattattatttattaatccttcagaaatcactttggagcctgcataagagtacatactccagagtctgactgaccatgttcaaatcctggttttgtgacatagctcctgggctaccctgggcaatttacctaaactggctttgccctacctgttatgcaaaatgggggtaataatagtgcctattatatagggttgttgtgaggattaatcgagttaatatttgtaatggcctagaattctgcctggcatagagtcagccttatctgagttgtcattattatttttacaaatgtatcctatctactcaggtgacaaattatttttatttcaacattattctctcatttatatacataaaactactataaattttactattctatagtcagttgaacatcttatttaacaaacatttaaacaagtgtttaaaaatgtattctttgctggacacagtggcacacacctggaatctcagcactttgggaggctaaggcaggaggattcctctaggccaggagtttgagaccagcctgggcaacacagcaagatcccatgccttcaaaaaaattttttaattaactgggcatggtgacacatgcctgtagtcccagctactcaggagcctaaggtgggagaatttcttgagtccaggagtttgaggctacagtaagctctgattgcgccactgcactccaggatgcatgacagatcaagtctctatctcttaaaaaaaaagtatacttagtgttctgtttatagaaacttttgaatttgaaagtgagtataaaattgctgtagtatagagatcacattttgattctttatggatgaataaggttgttatatggtcaatgtataattagtatccaagtgaaacttaacattttaaaagttaatgttattaacattagagaattatgcaaatagaagacaagaaagcaaactggaaaaggcatttcatcttgacatgaaagtttggattggttgttgagattcagaaatccctttgacagccaggctggggggtggagggttattgtggcttctggggcaacacagtgctggagctggactttgatggactcatctgaaacacaaataaagaaatcacttctttaaaataagtttaaaagaacattaaatgtcaggtagcccaacctctatgacttctatttagaatagttgatgtaaatgggaaatataatgtacataagtgcattatgtaattatgtacatatattatacataagtgcatagtgcatactacatttccagatgtctatgttttgaattattgttatcacaacaatattcatgtttgtgatatttcaaagctctatatacagggaggagagtgattaaaagcattttaaaatgtgaacactagattacccttatttagctagatagcttaatatttttacgtaggtattcaatagaaaatggtacattatattttctctcctcactacaatagtgtatgtagaaaagcatactacaacagtgtatgtagaaaagcataccctattgcttttctttatgagttggcagtgggaagggtgaactgtgatttagcaagtactttatacttctaattgctatgttttttatcctgcaacccagttgcctatggatattgactgctgtcagtactccagtttgctacacactagtaagccactgataaaactaagaaatttagagtcttttgtagttccatatgaattttaaatttttttctttctgtgtctgtgaagaatgtcatgggtattttgatagggattgcattaaattgttagataactttgagtagcttggaaattttaacaatattaatttttccagtacaatccaatatatttttatttatttgtgtctttctcattttctttcatcagtgttttatggtattcattgtagagatcttttacgtcttcgattaagtttattcctagttgttttattttattttttggtagctattggaaatgggattgctttcttgatttcattttcagatattttgctattggtgtatagaaactctactggttattgtttgttgactttgtatcctggaactttaccacatttatttattaattaaaacggttttttggtggtggccatggtgacacagccaccaaaatatgtacatgtgggtatatatatacacacacacacacacatatacacgcacatatacacacatatatatgtatatatacacacatatatacacatatatgtatatatacacacatatacacatatatgtatatatacacatatatgtatatatacacacatatacacatatatgtatatatacacatatatacacatatatgtatatatacacacatatgtatatatacacatatatacacatatatgtatatatacacacatatatacacatatatacacatatatgtatatatacacacatatatacacatatatgtatatatacacatatatacacatatatgtatatacacacatatatacacatatatgtatatacacacatatatatacacatatatgtatatatacacatatatacatatgtatacctggaatatatataccagactatatataatcaggtcatctgcaaacagggacagcttgacttctttctttccaaatggggatatcctatactttacttcttttgcctaatttttcagctagaacttccattactgtgttgaagaaaaataaaacagtatgtgtgtgtgtgtatgtgtgtatgttttcctgcatacatacacaatggaataccattcagccatgaaacagaatgaaatcctgtcatttgcggcaacatagatgaaactagagaacattatgtaagtgaagcaagccaggcacagaaagacaaacatcatataacctcactcttgtgtggagtataaagaagttgatcacatagaagtagacagtagaatagttgttaccagaggcaggggaggagagagtggagaggaaggtggggagaggttagtaaacacgtgaaacgttatggttagccaggaagaatatgttcaggtgttctattacccagtagggtcaatgtaactaaagtaacatatatttcaagatagctgaaaaagaggattttgaatgctattgccacaaagaaatgataaatgtttaaagtgatcgatgtgtcaattacccctatttgaacattttactgtgtattcatgtattgaaacatcacactgtaacctataaatatgtacacttatgatgccaattataagtaaaagaaaaatttttaaaaatccaggaaatttggaattgtgaactgtaccatattagccaataaattataagatttcaatgatttgtagaccttatgcagctattaaactagcaaatcctattttttgcattaaaatgatcttggaaataatttatcacatgtatattttaagagctttgagatcatatacatgcagaagaaatgagcccagtgtgaaggggctgactggccctcctatattttgaaggtctggaagtggcacaacatggatattactgagtctaccaaagcctttactttcagacatcatgggagttgtgttctaggtgccactagaaaggttgacctgagtccagttattctacattagtaattcaccacagaaccatcagggttactgcaaactataagagttagattgaattttctgagatttatggaaaagacagggtacaataatttagtgactatcacaaggtacttggaatgggtacattaactgctaagtagcctactcgaggagcaaatgaatgacataacatccccactttacctttcatttattatggccaatctgaaaatcctaatgacaagcgacattttaaacaggagaactgaggacatttagaatagtgaataaaggtttggtggcatacatgtctgaagagccaacacaaagatcttcctgtggacagatagttacaagtgatgctttcccatacaaactgtaagttggttctggagggtgtagtagtaacaggattttaatgtgaaggcatctactgtaagttcagtttactaaaagcagagagtccttggcttatctatgtgctgcataacttaaaattacacttctatgaatgaagataggagctttgcttgaatttattctatccaaagagaacaatgtattggtggttgtgggaaccttgggagctcatcatgctatcaacataaaagttgcagtagagagaaaaaggagttgttgggcatctccagatatgagtcttgcctttaaagaaaaagatatcagaatatcttaaaataagaagatttatttccatgttcaaagattctaaagagattatctaagaattgatagaagagtttcaaaggcgtatcttgactatacaattacaaattaccttaaggaagatcaaaaagtagacatttccatggaaatattagtaggtttttaataaatccaacttttgaaaggaaaacacataaaatatcaaaggaaaatgcataactaaacaaggattaaaaaatatgaataaacatgtaagaataatgccagacaaagtgtaggatgggatgattttttgaaaaaatgttaaaaaatttaagaagtatttttgcaaagctagttagagcaaaactaacaaggaagatatgataggctcattctggagtagataagtatgaggttgcaaaatgacaacgggaaagcaagagctactcattcttcatttcttccattctatcctagccaaagaatacactttcagttcaaggaagagattcttcattaatcagataggggatcagagagtgagaaaacacatagcatttaaataaatcaagtctcagaagaattgtcaggccttaaatgaacttgaagatattattttagactaactgtcggtattttttattgtttttttattgttttatttattatcagtattttattgttcataaatatgctaggctgccatccatctgcagccttgatcctaatttccaacatttaggaaaaggtgaatttaagcagctatcaattattatgtgtattagtctccagcaaaggactaataaatagaggacataagaaatacttggaaaagaatatagtgatcactagaaagcctcatgagttcactaagaataaattattcgacttaaactatttggtctgttttgaaggaatactaatccaggaagcatgtttatatttgtagatgacataattttttaggcattgtagataaatttaaaaacgttaacaaatttgaaaagaaaagtctgttggcttgcatgatggaaaagacagacaagatgatatactttgttagaaatcaacctccaaagcatggaatagcaaaatacatgtgtaacaacattaaggtaaaaacaggcagaggtttcagttgctcacagtttttatgagacccagttgtgttttctggcttctaaagtatctaacacaaatcttaggctgctcaatgggactatctagctgctattagcagaagctctccactgagcagttctcatctggagtaatttggcttactctgggctgtgaattttaagatgaaccctaataaacaagaatgtcctcacctgagatgagtgaaaactatgttgtataagaaactgttgaaaccattggagatactagtttggaaggaatctcacgtgatgactatttttaaatataagaaaaataatatcatttacacatttctcatccaaaatattgaactaagaaatacgagccaaagcctgcctgtcctactcaacaaaggcaagtaatgtcttgctcgtgcctgactttcagaaaattcctctgtgttttcagattttcactttaggttagcagaaatgatggtcccttctgcttaagtggctgtgtaacccttgagcaggtcattacacaaacataccctgacttggaatatgcaatcctagtattaatagttatcatttaaaaataactccatatggacaaaggaaaagcctgagtatttcatgagcctcattagttcttgggactattgcacatcatcatgcatcttctgccatacttaattgtgcaacgaaatttgtggcacagttgcttggagggtccaggtgttttcatgtggaagtgcagcaaggggattctttaatatttaatccctctagggaggattagagcaagctgccttgttttagagggactgggagtctggcatgctgaaattagaggcgggaattgattcaggaaagtttaagcctgggttgaagcaaaaacctaactatacaggtaaaggttagaactagatataggtgttagagatgacagattgtgatttgttcaactattagtaatttgtatacatttagtgaataaaactggctttaaatagaaggtttaggtaaagttgaagaaaatataaaactttaggaaaagtgtaattggagaagcagaggttgaaatttgctgtgggtacagacagtaaagcatatgcacgtggtacaggcctgggtcccagcacacacagaacactagtcggggtccatctggaaagaataagcaggccaggctcagtagctaggctattaaagtccgtgaaatccttgttaggatgagttgaagggaaagtagcctctcaggcttgtgccaaccagaagacaaagtttgaattcttcccagtctcaaagagtgaaggtagatatatcagaccttctccaggtgaagccttgtttcatctcttcctcctgctcctcccaggacctgaagagacacatctacaactttcttactcctttcaggtttggatttgtgttctagcaaggggtccacttgtcttgacaaattactgtttacgtttaatttcatgtgatccaagatatgttgccttatgaaactcttgtgcatagctgatgggaatgtaaaatggtgcagccactgtgaaaagctgtatggcagttcttcaaaacatttgacagaattacagtatgatctgacaattccatttacaggttatatatgcaaaagagttgggactcaaacagatattttcacaaccaagtgcatagcagcattattcacaatagccaaaaggtggaaatcatccaaaagtccattgaaagacaaatggatcaacaaaatgtggtacacacctaacaatggaatattatccacccttaaaaaggaatgtaatttcaatacatgcaacaacatgcatgaaccttgaaaacattatactaaatgaaataagccagacacaaaaagtcaaacagcatatgattcgagttatatgaggtacctagagtaatcaaattggtagagacaaaaagagtggtggttactgggggctggggacaggggtgaatgggaagttattgttaatggatagagttacagcgtgggacgatgatgaaaagttctggggaccaacggtggtgatggctgcagaacaatgtgaatgtacttaatggcactgaaatgtacactaataaatggttaaagtgttaaattttatgttatgtatattttaatcatcaaaaaattaaaatatattgccttagagagtaatgagctttttaatttttatttatttatttatttgagacagagtctcactctgttgcctaggatggagggcagtggcgcaatcttggctcacagcaacctctgcctcccgggttcaagcgattctcatgcctcagcttccagagtagctgtgattacaggcactgccaccatgcccggctaatttttatatttttaatagatatagggtttcaccatgttggacaggctggtctcgaactcctgacctcaagtgatccacccacttcggcctcccaaagtgctgggattacaggcatgagccaccgtgcccagccgagtaatgagcttttcaccactgacagtgatcaagcagagcaatcagacagaagtatataaaaacagatataaaattaaaatgtaaatagtatatataataaatgtataaatatataatatatattaacatatatactataaaaagttatgtaaatgttagaatagataatatagtcatccctctgttccctggggattgattccaggatgtctacagatatcaaaatccgagggtgctaagtttcttgtataaaatgggagagtatttgtaaatagcctcctcacattctctcacatactgtttaatcatctctaggttatttataatacctaacacaatataaatgctatgaaaagttgttacatatatttgtatttgtattatttttattgttgtattataattgtttactcttacttttcctcggaatatttttgatcttcatttggttgaattcacagatgtggaacctgtagatacggaggcctgactgtttatattataatatataaaataaatatacatataaatatataaacatttaaatacacaacatatatcatatataataagaatacatatgtatatttgtggttatttgtctttaaagcatcttgtagtttgtgcaaattggacaaattataacttcactacacctcaggtattttgtttatgaaatataaatcagttcctacattgaaaagatgttataacaaccaaatagcatcataatatgaaattgaccagtttttgtggtttatcaaatgtccattaaatgttaatttctattggactgaacataatgaaaattacctttcagttttctggaatttatgattgtaagaggaggtagcatcaccaaaaagtaatgacagattgattttgagatgctatgcaggcatcctgggcaactgtggaagaagaagcaggtttacagaagttatgttccaggatggagacagaggtgttcctcctggtcagggtccccatgtgtatggatgaacactatggatgaagctcgtgggctggtcaaacaccaagtatgaactggcaacactaaccaggcagggaaatgggttgaaactaaaggatcagctacaaattggagagaggacatattaggaagagatagttatgttattagcccaaattagacttaggagagcaggaagggatgtttagggaaatcaggcaaggaagaggacagaggtgctgagacacttctgtcgacctgactccttcccattgctgagcttcagctcaggcttagccctcctcgcctgtgacctctcatccctcagcactctgatcaagatctccttgctgaagctcctgagagaagtgacaactctcttctgcatctgacacacctttctctcttagcacatggaccattttattcactcatgctgattccaatattagacttgaagtgctttgaaagaagaagcaacattttctttgcctccttgggagttatggagccaatgaatcaaataaaaacatgcacagacaagaaggctctgcaatgcatgagccagtcagaggctctggaggattctttgagggaaaagaagctgagcatcgtcttctaaaatagccttctccccgcaacattaaagataactggcatttgatctacatcttggagagtcagatagaaaaggttgctttttatctcttgaaattactttatctcacattgtttgaaccttaactgaactgctaaccaccatgaggacactgtacatcatgttataattacaggtgagcatgcgtgtctcccgtcttctcggcaaattctccaggtccacagagagaccattcatctttgtggaacacccactactttcttacctaggcagtgattggaagaaatattaggtaccacattagtattttggagtgaatgaattaatgatataaattctcaggacattcaggcagactgatgacttcaggggtctgtactaataggaagaacaagagtccatctgccttcttgttacttgatcagtaataaaatcaaaccaacagtctgcactcccagatgttgtgtaggctgtgtctttaagttaaaaaactacaaagcctcagtgtgccacccagtgcctagtaggcctgtgccatcagtgtagaagactgtgctatagagatctgtgacaagggttagtcatgcagtggtacatatacccaggtgaaccttggcctgttttacaaaaaaataaaaaaataagccaactctaagacagggttagtttaagtgtagtttaatagttcctatgtacattcttagtaagaaatgttagcccagggattttaatgcaattagaacttaaattctatttctgcaaagaaatgagtttttattaacattactgatgtgaaatgatttcagaaatccccaggctgccaacactgaaatttgatccatagccttgattctcctcactttgcatacttgtatttattcattcattattcatctattcattcattaagctattagtcacaaatatttgttaatgtatgaatggtatattatctgttttttaaggaaattaaaactatgagatatagcactagattatagcctcgcctatttcactgggcattttaggaaggcagtaattgataatgtgtcattaatttttatgtgataatgtctattgcagttcctggcacatagtaggaactccataaatacttactaataaataaataaatttcctacccttatagagaattttttgtcaaatgtgagtaactaatttttcttatcccatatggagaataacttttttgtgactaatattattgggattgaaacagacacaaagacaaaatttataatataaaatagataaattgatttaagatttcacaggcatgatgttaatgaacatttcagatgctgggagaaatttcaaaactaaagctacattttaatggctccttaaaagaagcgagtgtgcataagggatttgtgaggagaagggttgattatagctcaatctgagatgtttaagagtggatctttaactgaatagaagagattgtgttttgaaaatggaaagcatacaggttatttttgttttaggaaggagacaccatgaatatctcaaagctttagagaagtgaaattcttttagaaaaacaacgttgtgattaaacaataaaaacaaaatataagcaccattcttgccatggtttttgttatttctaatacaaattatatgtaatcatcaagctggaaagggcactaaagatcttttagcctaccttctttttttaggtgagtaaactggagaatatagagatttttcaagaactgggaagggtctgagattttaggctatttgcaaactaactagttagcttgtcacggtttcatgaatgctggtagaaaatgcaagactcctggataagaggtgaaagacagtttcttttttctttctttcttttttcttttttgagacggagtctctgtcatgcaggctggagtgcagtggcgcgatctcggctcactgcaacctctggttcccaggttcaagtgattctcctgcctcagcctcctgagtagctgggactacaggcatgtgccactgtgcccggctaattcttgtatttttagtagcaaagggtttcaccatgttggccaggctggtcttgaactcctgacctcaggtgatcaacctgcctcggccttccaaagtgctgggattacagacgtgagccaccgcgccaggccgacagtttcttatacacggaatgacaataaccaatgtatcagcatctgtatatccaatccttaagccccatttcccacaggggacataaagaaggctccctgatacatgtacaggcagagctgcatggcaggaggagagccctgcacttaggacccaggaccttttccaatgggtagaaggcaagtcggccctttctcctggagggtgatttatctttattacactagagagtaagcaagctatcccttttctctagagggtgatactgcctctatcttctcaggctgtttgctttccaaacaccttcaaaaactttatccagaacacagggcagtcagcacttcactgtcaagatgcacagaaatgtgagagattcatagagaattatttttcagcagggatgagtcacttgtagaagaccacacagttgtcttcaagctgagggttcttttcacatcattatgctgtttccccataaatacctgaagccacatcagcattttcatgatgcgtagattcctattttctggaaatttgttttttccattggagaggcaaactttgaaatcttcataataagattcatgaagtcaagacagtttatgctgtttctaaatatccaggttgttttactgcctcccttgcttctgggatcagcattggcatcccagttttaccttggatagaatgtggcctggcattgcttaggctgatggaggcagtggaggtagttaagaaggagatggaaccaaatgtccagtaagtctgaatacaaggtaactcagcatcacagatgattttcctgttttctcaatttttctaatatttgtcaccagtctaaatgtacaaagtcttagggatgtagatgaaattctgtggcttacttacaacacttaatttatgactttaattacccatacatacttcaatcacatatgcaattatatggtatgttagtgaaattgctctttctcccgtctcctgaaaaagtgttactcaaattctacacatgcatttgcgacatttagagccattttggggccatctgacgtggttttccaggaccatcatttctacattcatattaagtttatttttaatacagcagctgttgtttctgtgcataaattttatcttaaatataaatatattagaaagctttgtttttacatctgtgttgtgaatatttcatgatctctaaaaattaacaatgtagtttgtggcttttaaagacaatatttaaaaaccttgtgaatagtaacttccaacggtggcaggtataagggcataaccctagcgagtaatcctaaatccaggtcacatttctttgccccactttctatcaactcatttaactgagctccagagcatctcaactagaattagcttagggcatttcaagataatgcagcttcttcaaaagaaagggtcctggaccataagtcacttcctaagaacttgaatatagaaaaattccctttttactaagagatgatcctcacctgattatgcatgtgatattagcttaccttaactaagtaatttacaattctaatcccattttttctcatcaaaataggaaaaatgtatatactgctggtgtctgagagtagttatgagtgttagataaaataatgaatatgaaaatctacaaaccataacttacatttgtttatgtatttgtttatgatgttcctcccctgtcattctctatcttgattgttggcacccatatccacccaggcacctaaatttcaaacctggaaagagtctttgatttactccccctataaaccattatcaagtcctgccaaatttttaccttagtatatcctcgtctttatggtcctcttatcctaactattgccttgttctggctttaattcattgtgtcttggcaggctctatgatcacctgagagcctctttttcacacagccttcagagtaatcgacataaaggtgaatcaaattgtgtcactcttaaaattaaaatcttccagtggttgacatttgcctaaacacacccaaagtgcattcagtaattccaagttctataaagaaatctcctcttaataagtaattccaggccaggcacggtggctcatgcctgtaatcccagcattttgggaggccgagacaggtggattgcttggagcccaggagttcgagaccagcctaggcaacatggcgaaaccatctctacaaaaattagctgggcatgatggctctcacctgtagtcccagctacttaggaggctgaggtgggagaattgcttgagactggcaggttgaggctgcagtaaactgaaatcatgccactatactccagcctgggcaacagagtgagaccctatctcaaaaataaaaaacaaacaaacaaacaaaaaaggcattccaggaccaggtgcagtggctcacacctataatcccaatgatttgggaaactgaggccaggagtttgagaacagcctgggcaacatattgggaccctgtcccctgtctctacaaaaagtaaaataaaaagattagccagatgtggtggtgtatacatgtaatcgtagctacttggcaggctgaggcaggaggactacttgagcccaagagtttgaggctacagagagatggtgccagcgcactccagcctgggcaacagagcaagattcttcctgtcttcacaaggaagaaaagcattccataatagaaataattagaaattctgtgtaatcgaaatttttattgctgaaaaactcttatttgcatagtaaggccttataggagtcctagaataaaggcatctctttgtttccccaaaaatgtgatattcctaaatgaaattttttttgtttggcaaaacatctgttattgctctgagaaaggcacacatcaaaacgcaagcccataaaataaagcccaaactcctaaacatggtccagaggcttcctttcatgacctcgacctgcctgtttctctctctgcctttgacctctcctgagcccccaaccccaagtgctcgtaactgttagcagagtttgcaagaaaaagagagatatgttggatgtcctccaaaattgaggtgtagtctacactcttaaaattgtagtaagttgtaatatttattagttataatttatatttaaaattgtttttagatgataacatatcaccttatctttctctttgacacatgtagatgtcatcaggctatttgttctttggaggtagcacatacattttaaaggactaaattcaacaccaagattgaaattttggttgatattttaagagtcagtatattggcataccatacagattcatatcatggagataacagatgggaaagcggcataaggtatgcctaatttatcaaacctaggtagtgttcatatctcaggcatgcatatggaggaaaggcctgaattatgtcactgatagttttaccaagaagtacttacatttatgagattgagagttgaagctaattaatgatcttatacctttttttttttttttttttagtactcaaaagatccaaagttagtagtttgataattaggctgtacttcattttcagacagaaattagacatgattaggaatgctgaagcactgggcaggtcagttgctcatcattattaaagccatttaatgcattttaatggtggttgataaggtacaaaatgctacgtaagccaaatgaaaaagttttattccattatatgttaagcgtagatataaatgagttcccatttgcattttttatgcattagttcaaaaaattaaacatttctttcttatatatgagtaatagaatgtgtaatttgtaagagatgggcactgctgaagccagcacctcttcacactgtgcacctcaggattctcagacacaaattgttatgtaatagaaaattaaggaaaagatcttttcagcatttgtgtggctgaagaatcgtgctttaagctctaagaccaattgcttgtgtaagtggctcacatttattaataatataaaatgataatctaggtctactgtcttatttatgctaggcttacagactttgttaatttatagaggtaaacaaacaacaaaagagatagtgcatagtatagtttctggtgaatattctattttgttagccatgttttgaaaatattctatggccgggcgcggtggctcacgcctgtaatcccagcactttgggaggccaaggtgggtggatcacgaggtcaggagattgagaccatcctggctaacacggtgaaaccctgtctctactaaaaaaaatacaaaaaattagctgggcgtggtggcgggcgcctgtattcccagctacttggaggctgaggcaggagaatagtgtgaacccgggaagcggagcttgcagtgagcggagatgtgccactgcactccagcctgggtgacagagcgagactccgtatcaaaatatatatattactagttcccatctactttagagcaattcttatattttaaaattatttttcataaataacttagtgttgggatttgaggataccaataaataccatcctttttatgtacctggtttagaaaccattgagacacagttacagacagatggagatcaaaatattccttttgttaactgataaggagctattggggcttgtagcttatatgtgatgtcaggtcaagtggatctactaacacgttctgatacacaggctaacctgaggatcagtacttgggagggaggtttgaacctgcagagcagagagacttcctcaggatcgctgcctcgctttggtccaagggaagaggacagatagagaccatgtctcccatgctccactcacatgagaggaccaatggctgtcatccaccaacagatagctcattccactactatgaagagtactaagaattagacaagagccagaacaggtcttttgttggaagccagagtaatagcagcaagcaccttttatgcttcctaaacctcctgatgtggacaacacatgtagtttatggtagggctacacagacagcacactaattgatgatgccactgccttgtattgtcttaagggaggcaatgggaaacatagtatgtctttattctatttcttgtgtaaaaagtagatggaaatggatgggaacatccttggttgaggggacagaggttgatttcaaggctcttattacataaacggtaaaagaggagaggtcctggtgttaagctcatcagcgtccagcaacctcagccacaatgtgtgtctctgacctactcagggctgtccacatcagaaaactggagcataagacagtctctctccaaatgctcttgtcttggaggtgttcccaggcttcaccccatgcagccacccaaagggagagactgccaggaaggcggggaggaggcatctgtcctgattattgagtcaccaggtagctattagtggtcatccctggttcttcctgtgactgtgtgcacattacatggaatctccaagtggatgggctggttactgattgagactcctaagaagattgtgtctaaatccctgattatgtcatatcaaagcaaatggtatcaggatataaccaggaaggtttgttaaaggtgaaatcactgtttcataacagcttttgaaggcataagaaagccaaaatagttgataaatctcatggtgattctggacaagcaaggatcttcactgtcctcttaatgaagtgtaatgcaagtagctaacatgtttagaatgtgccaggcagtgttctaatagcctaacatgaattaatgaatttaaagtaaattagttcattttaagtctcagaaaagcccatttgggatgattactactattattctgttgttttgaggtggacagttctgtagatacctgtcaggtctgcttgattcagagtcgagttcaggtcctgaatatctttgttaattttctgtctcaatgatctgactaatattgtcagtggggtgttaaagtctcccactattattgtgtgggagtctgagtctctttgacaatctctaagaacttgctttatgaatctgggtgcccctgtattgggtgcatatatatttagggtagttagctctcttgttgaattgaaccctttcccattatgtaatgaccttctttgtcttttttaatctttgttggtttaaagcctgttttgtcagaaactgggttttgttttatcttcctattatgaaagagggaatgaggttcttagagggctaaatagcctactgacattccccagctaaaaaaaaaaaaaaaaaaaaatggcagaaggacaagagccatctctacagctggagcaccaaacccccgcatcacactgcttatcaccaacgcagtagaatcactggtgattcctactaagctgagtccaattctagaaaaaaatctgtgacttgtgtttgtttatttagttttaaaggaaatacaactaataacatttattaaaagcaatttttagtgttggatttgatttcagcaacattttagcaaatgctcatttctatatgacctgatcttatgtttatggatgatttgttttgctttgcctttgaagtttatatttgaagtgctaccaaatttatttagttgtttacttctttgtgtgttggtatttccttccttccactaatagcgtaagctctgtgaaagaagtgctcagcaatagtaggaattttttaagtgtttgtagaatgattaaaagaatgaatgaatgaagttaaaaagttaattgtttatttagcttatagtgacctggtatctttataaacatagtctacatagtcttaaatggagaactactgttaataactcaattgttttagaaagatgagacaaatgaattatttaaaatccttgcaggtctatgattttgttaaacgaaatgtacttaatgactcatattcttcatataagtgtgtggttaatgattcatatttttaacacaagtatgtacttatttatttttaattgatgtaaaatgaaatgatcagtgaagagttgtgtttaaaaatattttccttacaattcccaacagctttaataataagcagtctcatgcttgtttgtttttaactccagactttgtatatatgatttcctctccctataatgctcaatgcattccccttcatcttattagctcctttttatcatttagatattagcttccacatcttttcctccaggaaacatttctaggcccttcaagttgggccaagtgtacattctctgctacctctctggctgccttcataatgcagtgtagcttactggtcttactggatggtttccccaaacccatattgttctcgatgttaagactctctttagcacctagtacaggagcagacagagaaaaacataaatattgaatgagttgagtgaataaatgaatgagcatcaataactaagaaagtgggcatgctataagaattattctcaagtaacagtaaatgagtttgtaaaacagaataggagccccaggcaggaatcagagggacacatttagactgccctgcatagctcaaatggtcataatggtttcaggcattttgaaagctgggcatgtatcatcagctcatgccacgtaatttccaaccttctatgccaatcccagaagcaaggagaatgaacataaaaccagggaaaatgaataagaaacacttggtgaggaaacagcaactgcaggaagggcacagtgagccaaatgtaaggacagtttcccaggtgggtggagaaacccatgagacattggaaactgtaagagaagcaggcaagagaaactgcagaacccaagagaaactgcacagtacaccaacagcagcaaaagtgaaggacaccacaaggtagtgataccacaaggataaaggaatagtggaggagagcaagatagtattgctaaaagaaaaacttcagccgaattaaattcaaaggactttaattgagcaatgaaggattcaaaaatcaggcagcccccagaatcacagcagattcagagagactccaaggatgcctcatggtcagaacaaatttatagacaaagaaagtaaagtgagatatagaaatcggaagtgaggtacagaaacagctggattggttatagctcgggtttgccttatttgaacgcagtttgaacactcagcagtgtgtgactggttgaaatatggctgctgggattggccaagactcccgagattaaggtaatgttacaggcgtacactcctaaattaggttttcagtcttgtctacctattaagttaggttgcagttcatccacaaggactcaaatatagaagtatggagttcttctcagtccatacttaagtttgctgtaacagtatgactagtattatgtgcagagggcaatacagctctaagagaaacagttataattgagctctgttctgctgcagtcaatagaagtttcctctgacacatacttggtaacgctgttacccttcgtttgcctttgtgcatacctaagacatcttccaggacttttgattctcttgataatgagtcagcatgatgatgggccagggtcttgtaaggagagctcactttttggaatggatcttcctctagctttgttattctcagctcagatttcatcctgcctgagcccttatagtagaacagtaggtagctacctaacaacgtctgagaccctggacattccgcctttctcctcaacacacagttctttaatgctaccctgatagctgttttcttcaaggacttaggtgaagctgcagactgtctcatcaaatgagtgtgtcatcagctctctgacaacatattgtagagtgcttctcaaatgttaatgatcattattggggtcgataaaatatattattcaaaaattacaatacaaaaaaagtatgttacaagtgccttaaattgtcagagaaaggagaaataatttatacttggagtgactaaacaaaaactccaaggggattagatgaaaattatgttgtttctgtccaataagctaccccttgagcaatctaacatttatcataaattctgttggtgaatctgctatctcagtgactagctctatttgaaagaaaaagatagtttctattttcaagcagaaaaatatgaattacttgtctaaagtattaatagaaagatgtttaatcagtccttagtctctttctattgtgcaatacagatgagaaataatttcaaaaacgatgtggaaggatgcagtgtgccatgctagggtgaaatggttacccagaaggcatctcttatttggggttccttctctgtatagatgcttatgtgagcttaaattttttcatgtatgcttttctttaaagcccatcagagtataagaaaaactgaatgtctgttagccatattaatgagtgaatgaatggtttcctgtatgtgttctgttgtaggtccattaaatgaaagcactgaaacaaattagggctttacttaatgtgtatattaattggctcaagcctattaacatacaaaaagttaattagcaagtcaggacttgtagtaatgtcttaaaggtggttgtaaaacttatgtaaaagactttttctccaaaccattccacttctctaacttggaaagtttatgtaattatgaaatctgatcctaaaggatgtagcaaaaccagtggtctttcttactaaatttgttggccctgcacctagcctccaacatttttataatggtgcttctctttcatggagcttcaaaagtcattacaagaaattctactcctttgttcttccctttttaataattaaaaaaatcatctggctgggctgggtggctcaagcctgtaatcccagcactttgggaggccgatgcgggtggatcacaaggtcaggagaccgacattctggctaacaccgtgacaccccatctctactaaaaacacaaaaaattagcagagcctggtggcgggcgcctgtagtaccagctactcctaggctgaggcaggagaatggcgtgaacctgggaggcagagcttgcagatcgcgctactgcactccagcctgtgtgacagagcgagactccactacaaaaaaaaaaaaaaaaaaaaaaatcatctatgggatattttacttccatagtacacttaagtttttcttgcctcaatcaattaaaatatacatttgttaaaaacctttatttgcagagtaattgtccaagctgccctttaggatgaatcagtagagcttaaagatgatttgttacaatattaaatctaacaagcaactgatttgtaattttctaaagatattacggggtgaagaatcaaaatggacagcatctagaaatctgtcaaaatctagatgccttcttattacaacttacttcattttaatattgggaagttagcttaacttcaaaagattttgtctcataatactctattattattagtttgataaatttcaagtatacagaaaagtatagagcaaatatcccaaatacctgtgtgtcttttgccagtttcattctctcctgtcttccacattgcagcatttggtgtttattttttccaataatctcttagtgtttcactctatagttatagactcataaacaatatggtattgtttgcatatttaagctttatttaaatattagtacataaaatttaaatatgtgcagtataacaccattattgctttttctgctgaacataatgtttttgatatttatccatattgttgtatgtagtgctagttcatttactttaacttctatgttgtattctatatagaggaatgaacatttatgttgtttctaatttttattcttataaactcttgccatttatgcatatcatcttgtacacatgctacaagaatttctctaagcttatcggtgtgaaattgctaaatcatagcatttgtgcagatcttcaacttcactaagtctggagctttcagtttgcacttatccctccaggacatagactgcatattgcactgataccaatcagttctttctcactataaaattttttttttaatcttttgagtgtgaagtgatatccagttgttgacttaatttgcatttgtctgattagtgtgagcttgagcatttttgcttatttgctttatgtattttttaaaaattttaagggtaatactggcctcctaaagtaaatttggacgtattccccccgcttgaatttttcaaagtttaagaagaattggtattcgttcatctttaaatgtttcatagaattcagtgctgatgccatctggtgctgtgcttttctttgatgtaaagttctaaattacttattcaatctccttactcactattggtcttttcagactttctatctgttcctaatttagtctcagtaggttgtatgtttctaggaatttactgttttattttaagtcatctagtttgttggagtataattctttacagcagtcttttgtgattctgtttccttttttttttttttttttattgaggtggagtctcactctgtcacccaggctggagtgcagtggtgtgatttcggctcaccacaacctctgcctccagggttcaagcaattctcatgcctcagcatcccgagtagctgggattacaggcatgcaccactgtagttgattaatttttgtatttttagtagagacagggtttcactatgttggccgagctggtctcgaactcctgacctcaagtgatcagctgcctcagcctcccaaagtgctgggattaaaggcgtgagccactacgcccagccgcttctttctatttctgtggtatgttttaatgtctcctttgtcatgtctgagccttctttttattctagttaacctcactaaagtattgtcaattgtcaatttcatttttattttcaaaaaacaactccagttcattgatcttttctattgtttctctagtttctctttatctctgctctgatctttattttttctttcctcgtactaactttggattgagtttgttttttttcttgttccttgaggtataacacttggttgtttatttgagatttttcttcttttttaatgtaggcatttatagctacaaaccgccctctttgaactgcttctgttgtagcctataagttttggtgtgtaatatttccacttttgtttgactcaagatattttttgatttttctttcaatttattttttgactcttggttatttaggagcatgttgtttcatttccacatatttgttaatttttcagatttcctcctgttattgattctcattttgatagcattgtggtcagaaaagatacttgatattatttcagtcttcttaaatttgttaagacatgttttatatcttaacatatgatttatcctggagaatatttcaagtgtgcttcagaacaatgtgtattctgctgctattgaatggaatgttctgtgtgtatctgttagcattaccataataacaaataatgctagcttaccctgataccaaagccaggcaaagacagtgtaagaaaaaaaaaaatagggtgatgtccctgatgaacatagatgcaaaaattctcatcaaaatactagcaaaccaaattcaaaagcacattaaaaacaccatacatcataatcaaatgtgatttattttggggctgcaaggatggttcaatatgtgcaaatcaataaacattatgcattacattaatagaacaaaggacagaaaccaaataaacgtgatcaatagatgcagaaaaatgttataacaaaattcaacattcatttatgataaaaactctcaacaaattagatatgatttagtatgtaaggattgcaccttaccacaataaaggtgcaattttatatgtgataagcctacagctaatatttatgctcaatggtgaaaaactgcaagttttctttttaaatttatgcacaaagcaaggatacccactctcaacactactattcagcataataactggaagtcctaatcagagcagttaggcaagagagagaaataaaagacctccaaattggaaggaaagaagttaaattgtccttctttgcaaatggcacaatcttatatatagaaaaccctacagactctgagaactagtaaatgaattcagtaaagttagaggatatgaagtcagcatacaaaagtcagtagtgtctctacactaatgaggaactatcataaaaagaaagtaagaaaacaatcccattaaaaacagctacaaaaaataaaatacttaggaataaatttaaccaaggaggtaaaagacctgtacactgaaagctcagcaacactatgaaagaacttgatgacacaaataaatggaaagatatcttatgtccatacattggaagaattaatattttttaaatgttcatactccccccaaggagatctacaaattcactacaattgctgtcaaaatcccaatgatattctgtatataaatagaaagaacacttctaaaattcatatggaaccacaaaatacccaaagacaaaaaagaacaaagcttgaaatatcatagtacttgatctcaaaatctattatgaagctataataatccaaaaagaatggtatttcacaataacatatacaacagtagacagaatagagggccaagacataaattcatgcatttacagtcaactgatttttgacaaatgtgttgagaacacacacagaaaggatcatctttttaataaatggtgttggaacacctcaatatccacatgcacgtgaaagttgtcagaatcaaaatgaaggcactggtattaaaaaccaccacaaatacagctagctggggaagggcatgaaggggggcttctccggaacaaatgcctgataacaagaactatcataaaagattctgcaaaaaacaccttgtgcaaaaggccatcacaaccttacacacacacataagtcttgtggacatctgcctatcatctgtttgtccaaactcagactggtatcatacttgttattaatacatgtagtcaaggataattatctcaaaactattatttaattattctcattttttctttaaaaactttttcttgttttttttttttaacttccctgaatatgcacgtggcttactatggcacatgtattcccattgcaatgcctattctaggaagaatattattttcttttagagagtctcccttgcagtttgttatttattgacaaaatggtgtcagaagttaaaccaaagtgagctcacctaggttcaataggtggctcctggaatcatgtaaggtagcaattgagccctttgcactcttcatttccatgagtcaccttttctgtgctggtaaatctcctctcagattcttttacttcttcctttgttgagttctttttaactttattcaagatctgatttggctataaataaggctgccctaaataaaggaccttgtatccgtcttaagactatgaaagttttttctgttgtttttgtggcaagccctttctggtataaagacaaatgtccttctggttaagtactctggtttttacagaatttacattgtgtctatgagggtgtcttttttggtgaattcacttttgattctgcataacaggtttaatatttgtttgatctgcatacctgggttaaaatgtttgtgagtattctgattttggtttcattttggttatgcatgtctgtaaatgatttgactccttttcccttgcatgtttctgaacatttccaagagcaaaaataaacattctaaatggtggacatggaatggccaacagagcagtcatactaccatctacaacacctgttcaaattactgacattccctgagagaatttataggaatgtctttgctcttgagagaataatgagaaatggaattggattcttaaatattaaggcataccaaaactttctctgactcctgatggctacatagattttcctcatgcatgttttcaaatccataaccatcagggggattatttgaactccccccaagtctgttgtttttttttttaagagaattgtaactatacagttaacagatagagccttccaggttctgcctatctcactgtttctttgcctgcctactttgaatctgctgacttttctgctgatgttgagataaacttactgcttatggcattccagccaagatagaaaaaaaaagtcttaaagaactttgagattaatgccttacaaagtacagtagttccatggcaaccaatacctagatttctttttgagatgttaattttggcttgcctaacagttccttagtgtgatgaagcagttagttgaagagttgatattttaaaataaaagagctatttaaatgtttataaaagttaccaaatcaacagtgtcaaattattgaactcagagaaatagtataaagtatctctgtcagcattgaaattgctgtatctgtcacacaaggtctagaaattgctgaagaaaaaaataataacttaaaaaaatgtataatttcttcctggccacattgactacaaaccagaccagcaaacaaaagaataatctgttagtagttcaaggatgcttggacagtttgtttttcttatatgattcagccagtcctacgcgaaatgtaaacatttaaaaatttaactccttaaacttgcttgaagctgaaaaaagaaaatgggggggaacaaaagacaaaaagcattaaaaaatcaaactgctgtggaaattgcatacatgtatatatacacatctatgcacacacacatacacaaacacatgatcatatatgtattcctctagtaatttgtactgaagtaccttgaccatatttattttcataatttggctgttataaacggaaaaatcttcttttcactagtaactggcctagtatctgttcaatattattaaggaatttttatcaagaatgaaacagctagcactacctattgtattaaaattgtaaaacattattattaaatttttaaaattgtaaaacattctgtacatctcaactatgggcaagaatgtggtgttagaaaatcattttctatgactggacttggagcagacccagaagaaatgcagcaggaattctacaaagtccagctaccttagacgtggaattgcttcttttgaaatttaaaaccaatgaaagtagatgcaccaatcaagtctatatgagccttcagttgtaaatgtgtttcatttcaagactgtctgtagtaaatcttagagaacatttttaaacataagcagataaacatggtatatcgtgagtcatagagtaacttaacttacccttctgttgctttattttattaatgattactgggttgatgtcttgccatgtcatcttatcctcaaagtctgtgaaaattatgctcctgttttctgtttaatacccctgcaaagccaagttcagacaacatattttgttgttgttttaaaggcagcctgttttcttatatctctctctccatcttttcacttttcttagtctatctttttttaaacaattttttttcttaattctttcaagaaccatctacatagattatgtttaggtgtttttggaatacaatgaaactagtttttatatgcatagtaagaactttttaaaccttcttgattaaaagacttagttccattttaaaaattgttattctacttcagttattatttcttcctctgagacaatccattggttacctgttttctaccctccagacttatggtccccttgtttcactgtctttagcttttctactgaattctgggagaactttccctgtatccagttccttgattttatgttctgcaatataaattctgcaaggtaaatttttgcctttcaatatggattttaattctgggtttctgttttgtaataatttcatttaataaacttgaattcattctttatttcacgtacctccatttatttaatacactttaaaataattatttaatacactaataaataatttgtacttaatatactttaatgcattctttatttcacatacccctattttattgtatgttgctgtttctagtttcagactattctgctttctgtgaacagtgagaatgctaaggaagtttctaaaactttctttcagttcccatggtaaattattttcagtgctcagccccgcctttatttctgacagagaagtctccatttaccttctttgccaaaggattatcaaaatgccattccattccttttctgttttgcttttttttctatttactatacttgatgatagaaacctgtgtcagagatatatcttagtcctggtttaaacaatgaaaacataatggttttaatactgattagatactgtgagatagagaaagccaaactgattaacttggagatccatcagattttaacaaggaatttataaggactgaaacatgaatcttttgcctttatgtatagggcatttacttaaaaaaagaaaaaaaatgttttaggtcacacacacatatattctttaagtaatatttagtgtttaggtagatactgaagattattaatcttcagtcttatttctctagaaagacttaaaatgtcataaatagatgcaacttgttttctcttaattttgtaagatgagtagaaagttaagtcattattttctctgaattttggtactgatatatttccttttcatgtttctgaaaaaatatatggtattcttcttgaatgagaagaaaactgtcagctaagtgaatacctttagacattcatccatttatctggttgtggagattcgcatcatatattttgtgtcataattaagtagttgaaacaatagatgttatttaactatgggtatacttccttatagttttgatagctataatttaaaatttatatacttgtctatatgccagattcattctaaaattgtattgttctcaattcatttttattttatgtttccttgttttatgaagacagcaagcaattagaatctcataaaatcaaaacttcatgaagtatttacaaaagacaacacacatagaggcacagatagaccactttttataagagtctctatcttttaccttttgattttaaaataaaccttttaacagtcccttctctgtctttttgcaggcatttttaaaaattatattttctattgttggttttcctttagaaaagaaagaacattcttacacctaccagcaggacaagcaaattctgcaaagcaactttgcaaaacacttttaacaattgtagaatttgtatatttcctttgactcaggatgtctaattctagaaagttaacttgagaaaatagtcttgggttattcaaaaatatcactagaaagagaggcattatgtagctatttaaggtagttaagtgccaggatctgtgtgaagtgctacatttcatcccaaatattatccctttttggttcggataaatagaggttactctaaaagactgccaaattttagacacatttcttacaataaaaaacattttatgttgatagctgtaccatcaaatgaataaaatatgtgttataaaatcttcctggccaggtttacttttaagatttctaggctgaaattctactaactttatttgaaatagctgtatgatttcataattgttaagagagttcttagagaaaacatcagaaatcctgactacacaccaatatttttggatacctttattctcactgagagaggagagattatactgatctgttttgctcttatgccttatttatactctgccagtttggaaatttagaacccttccaaaccaaggctttttggagttatttcagatttacagtttaggtctcatgaagatttttatagttgaaataatggatcatttgatgtaaggttgcaaggcaagcaaagcaagtcaaacacttacttaaaagaagattaaagttacacatctattgcactgaagaaaatgagttgccattaattgcagcagtccatcaacaaatgtactttattatcacaaatgtgtgcactgtcacttcaataagctgtaaactgaatcccaataccctctgtagaaattatacttcttggccgggtgcggtggcccatgcctgtaatcctagcactttgggtggctgaggcaggcagatttcctgagctcaggagtttgaaaccaacctgggcaacatggtgaaaccccgtctctactaaaatacaaaaaattagccaggcgtggtggcaggcgcctgtagtcccagctacttgggaggctgaggcaggagaattgcttgaacctgggaggcagaggttgcactgagccaagatctcgccactgcactccagcctgggtgacagagcgagactccatctccaaaaaaaaaaaaaaaaaaaaaaaagagaagacagaagaagaaagaaagaaagagaaagagaaattatacttcttgacttcagaaagacaactaaaatacaactctcaaaatgagaaggtttttagtggctgtctctggagttaagtcatgtttagctagtgctattcactcaaaattccatttaaagtattttctttactagaccatagtagacttctacagagactaagaatattcataagtactggcaattgcagcctaactctagttagcataaattggcaaatgaagttcaaattatgcattggcttctgcaggagtgatgcagtacatcagttacctgagaattcaggagtccaggctaaggaaaatggtttgttagctttaatcaaaataagaagtattttccctcctaagaaggttgcttctatgtttcaactgtgagtgtgaaccatgaaataagagcttcttggtgcaaattgtacattgatacagtcaattctcatggtttacttaaaagcttcacattgtttaactattaaagaaaatcttggcaaattaaacagttctagcagggttaggggaggattgaaagattgaagtaaatctgacaaagcccaaatcaatagaaattcaaacaaatgtgtgttaaaactggctatttaaaccaaactttagtctgtaatgttatagcatattatctacctagtccatttatttggaacacagtggatcttttgaacatatgttactgaacttgggaaaagataatcacaactaaatcctgtatgcacataaaaagagctgcacaactctgtggcaacatttgcacaatttttgcttctttctttgtgtgttgtcaatcattaattatttcattttcaggacttcttatgtgtaaatgctctgttcccctacaccaaattaaataatccacactaccttaatgaaaatgaattatttgaaacaaattgattattctcaatattgaattcaaagtcaaccttacacattttgaattaaccagaccagctttttcactctccagcctctggatcataagcatgccatttaaactcagagatttaaatctgtcacctattaaatgggaccgatgtcatcaggcctatattcttcacatagtgtgaagatcaattatataaggtccatgaatcctatgaagtacagttcaaatgctgtgtatcaatattgataagcactgcaggtttttcctttgaaaacatgtttgaaacccactgatagcacaccctggaaatgagtaaatctgaaccacaggccatgacaatcattcaaggtgctgtgctggagggagagctcagacctgagagtcagagagatctgattaagacatagtttaggctacttagtatccatgagcccacattttatatatttagccgttctgaacttcgattgattttttgattcataagcgtaaatactactattatatttaggactgtcaaatgttaactctaccacctaaattaccaatcggagagacagaagatgacatttcataaggtatattcatatgctcagaacacaacctactgcctggacagattatatgggataaaagaaaaccagttacagaaagaatctttaatgatattaaaatgcttaatttacatgtactcctaaaactctaattgaatatatatgtttaacaataaattctaaggatttgtttttgacaaaatttcagtccacagactttgatgctgctgttctgagtcatttttgtttgcagcagtttcaacatgttcttacctttatattatacttgctcttgttcacttaaggagttcttacttggatttcttactttctgtgaggcactatgttaggtgctgggaagacaaagagaagagatgcaatctctctcctaatggtgctcatatgcagtcactaatgaaaattgttccaataaaatgtaaaatgttgaactgcaattgtattaggagtgaggagcactacgctgagctatgaaaactttcctaccacagagagttcccccagacacagggagcttctctgactttattcctgaatctatgtgctctatgtttgcagatccttcacgcatgggaaacactatggtgtatgaatgggattttaatgactaacacctaatatggaatttaaaatataatactctctgcagaaaggctttccctgatgacctaaatgttctagcttctttccttgccttaatcttgaatttaattcttttcatgaaatgggcccaggccttacttgtacatctccatctattctgacaccagcttatcatctaaatgctgtctctagtctgctagtcttttcaagtactaaaattcccacctttgaaaaacagtttttctgtgatagggactcccaggtgagtccttcttcttagtctacaggtgcttgcacctgtctgggaccactctgcatcttggcctgtctaccttgctctctgtaacattgtaccattttctctaggtactgatctcagttccaactcaagtttcctaatataaagctgtaataactgcctctcaatcttctcctatattcaaatgttcagcctagggattatatcatggggattaaaaatgcaaatatatttacactctattatttaggtaaaagggagttgtttaggccattctaggataatttaaatagtaaatataaaaaaaacttttctctagatattggtaaatttacatataatcgtattctcttatctagaatcaaccctccatggaagataattaagtcacaatagctacttttatactgactttatatatattttgatttttctatatataacacaaaataaccctgtagaaagacctacattgtatgcagataaagcattctaaacttttttcatgaatttcaagaagttcagtgaaaaactttagtacataaacattaagttttgatgagaaggttaatgtaatggaaaattaacaatagactaaaagcacattttactgcctaattcgcatttaattagaactgggttttcatttctgctatgaaaaaaatgttgattgctcaaaattatgcactcttcttttaaaaaaattcttccctctttgtttctttgtatctactacacacacacagagttgcatagtttcatatacataaacacagctttttcctctactctttcttcaaataaaagctccaaaattctcttatttattaagagcttatttaggctcttaaataattaaagtcttatttttcttttaaatggtttgattctcagaaccattttgagtgtaagagcaaaggtgaagtttcagtcattttcaagtatatgaatagcattaatgcactaacacactgttattgcctttgtggagtagaaaataacgaaataatgggctctaagtgtagcatagtgatatggtttggatttctgtccccaaccaaatttcatcttgaattataatcccgtaattcccacaagttgtgggaaggacctggtgggaggtaattaaaacatgggggtggttccccccatgctgttctcatgatagtgagtgagttctcatgagatctgatggttttgtgagtctgtcatttcccctgcttgcacttattctctctcctgccaccctgtggagagctgctttccgccatggttgtaagtttcttgagaccttcccagctatgcagaactatgagtcaattaaacctcttttctttataaattaccctgttttgggtattgcttcatagtgatgtgagaatggactaatacagtaaattgatatcagaaatggggtgttgctataaagatactcaaaatgtggaagtgactttggaactgagtaacaggcagaggttgaaacagtttagagggctcagaagaagacaggaaaatgtagaaaagttgggaacattttagagacttgttgaattgctttgaccaaaatgctgatagtgatatgagaaatgaagtccaggctgaggtggtgtcagtcggaggtgaggaccttgttgggaactggagtaaaggtcactcttgctatgcaaagagactggcagcattttgcctctgccctagagctctgtggagccttgaacttgagagagatgatttagcatatctgacagaagaaatttctaagcagtaaagcattcaagaggtgacagatcataaaagtttgaaaaattttcagcctgacaatgcagtagaaaagacaaacccattttctagggagaaattcaagccagctgcagaaatttgcataagtaataaggagccaaatgctaataccaagactaggggaaaatgtctccagagcatgtcagagagctttgcggcatcacttcccatcacaggcctggaggcctaggagggaaaaatgatttcctgggccagatccagggcacccctgctgtgtgcagtcttgggacttagtgccctgtgtcccagtatagtctaaaaggggccaaggtacagctcaggctattgcttcagggagtgcaagccccaagccttgacaccttccacgtagcgttggtcctgtgggtacacagaagacaagaattgaggttggggaacctccacctagatttcagaggaggtatggaaatgcgtggatatccaggcagaagtctgctgcagggatggagccctcatggagaacctctgctagtgccatgcagaagggaaatgtgagttcagagcccccacacaaagtcccactggggcactgcatagtggaactctgagaagagggccatcatcctccagagcccagaatggtagatctaccaacagtttgcaccttgtgcctggaaaagccccagacactcaatgccagcctgtgaaagcagcctggatgggggctgtaccacacaaagccacagggatggagcttctcaaggctgtgggaacctaccttttgcatcagtgtgacatggttgtgagacttggagtcaaaggagataagtttggaaatttaaggtttaatgacaactctgttggattttggacttacatggggcctgtagcccctttgttttgtccaatttctcccacttgtagtgggtgtatttatccaatacctgtaccccgattgtatctaggaagttactaacttgcttttgattttacaggcttataggcagaagggacttgccttgtctcagatgagactttggacttggaattttgagttaatactggaatgagttaagacttttggggactgttgaaaggacatgattttgttttgatatgtgaggacatgagatttgggaggagccaggggtggaatgatatggtttggcttagtgtccccactcaaatctcatcttgaattgtaatctcatagtccacatgtgttgtgggagacccagtgagaggtaattaaaccatgaggacattttccaccatgctgttctcataagagtgagtgagttctcacaagatctgatggttttatgagtctggcattttccctgcttgtactcattctctcttctgccatcctgtaaagaggtgccttctgctatgactgtaagtttcctgaggcctcccaagctatgcagaactgtgaatcaattcaacctgttttctttgtaaattacccagtctctggtatttcttcatagcagcatgagaacagactaatacacataggaaaaaggagccttcattttttttcaggacagaccttccactagggactcctacatagtttacctcctcaaactgactataaataataggcattcttcacattttcatattacagatgaggatacagaggctcaggcagggctcagcaggtgacagagctggtatatgagtcaaaataaatgtccctgtcatgatatctcatgtctgaggcaattcaatgtatttaaggaaaagtgccttgcaattaaggttgttaaatagtaaaatggattggtaaaggggttggtaactagtactttaacatgtattgtatgttaacattgttaacatgtatttgtttgaaatagcttaggcagacttctgcctaaagaatgaaatatagacaatgtagcctttactacaagctaggatccctgttatgagaagagttttaaattaataaatagtttgcattttcaaaggataaatgaactcattcttatgtctcattaggataactcagacaaccacttggacctctagaatcttttgctataagtctagttgtctctgtccctcatggaatgtcactcttgtatacataatgggctttttcatctctttctcctatcagatgccaatgggaagaaagactaaaacatttcagtgtttttctggctcattagataatccagcaggtgcatgccccactttccagcactagtcttaagcaatcaaggccctaaccaccccaggtactgagcatatatgcctgtgtcagagctttggcagaaatgacagtaaacaaggctgagtgtctctgtgctggtcctaggaatgccttgttgtaggaaagtggtagaaaaggttgtctaaagtttgttagataagcaagctcccatgtcaaccttcgagtttgcaaatttgagtaattactgtttaatattcaagtgcaaataaaacaaaggaaaagctctcaaattactttaaaatgttataaaagctttggtttggcaatctacagctcatactgaaaatgtgggtacttaaagcagatcacaacaggtgaattcaatcaaacattcatgtgtgaaatatgagctcggttgtaagccattctgaagaactattatgccaataaagagaaaatggtaatggattttttttccctgtgaagcacaaatggggactttataatttacttcttatgggttctattgagaaaacccattgtgatgtacttttgggtatccctgctttaaaaaatatcaattacttagttttccaattaaaaacataaattaactatgctttatttcatattacattttccagaatcataaaagtgaataaagtattatttccatactttccaaggctctttatcatttctgaatatgtggattattaatcagtttgctttttccttcccttgtcattgataagttctcctgtagttaaaatttttacctgttttttctttgtatgaagacgttttaaaagactgagaatcagttttcttcaccattcatcaagacatttttatcctttcaatcaaattcaagctaaaattttactcttagcctaaatcgttgattatgcatttaaatcttctttataaagggatgccctttactatattcttctctaccctcgaaagtcaagcttcttatcctttaggtttagaatgtactgtttgactagatggtacttctgatatacatatatatatacatacacacacatatacatatatatattagaacaaggcaattaggtggtgtttagccatataaagccatatatcttttcccaaagcctgccccatagtaggtaatatggccagttttctgaatagtttcattgaatagactcactccagtctaggactctgatagatggagtggagagactttgatctacagacaagactagaactcagttctcctaactactagcttaatgttctttccaatacatgatagttggttaatatcaatgactgtataactctcaataagtttttccctaggcatgaatatcttcttaatatttttaccaacctgcatgtataggctactttttcctttttctaacttctggttaaattccatcaattctaagtttaaaagttctttggttggaggagtcagagtgctggagaatcctccttgctccttctactaaagtaatgccctctgtctttagggactgcacagcattcagatgtgggctagcatgttgttttagtacagcccatccttgagcaacccagggattagggaaactgacaccatgcacagttgaaaatccaagtataaattttgactcttcaaaatcttaactacttatatcctactgttgactggaaggcttatggttaacataaacagtcaattaacaaatttacatgttgtatagtataatatacaattattttgtatacagtaaagtaagttagagaaaacaaaatgttattaagaaaatcataaagaagagaaaatatgtttactattcattaagtgggtcataataaaggtcttcatccttgttatcttcacattgagtgagctgaggaagaggaggcaaagtaagggttggtcttgctgtctcagaggtggcagaggtggaagaggtagaggaagtggaactagaggcaggcataattttacagaaatttgtataattttacagaaatacatgataatttctgtctaactttttgcttttccatttctctaagtatgtttctatattataccaacatttcttccaccactttctttagtccagtaaccatataaaagaagggttcaagtcataaatgaagtaaaagcaatatttaattattggaacccttcttccaatttgtctaatgtcaattcgttttctggcactgcttcttctatgtcttcttcctcattttctggcactggtttggaagctcttatcttcatcaagttgtcttctcctctggtgtggtggctgttagctctttaatttctccgatatctatattttgaaacccttcacgctccaccttttttccatatccaaaatttctttcacagtttccttgattggctctgtcagaaatcctgtgaagtcatgtgcaacatctggacacagctttttctacaataacgatggccactttaatggtgtaatcttcacagactttcacgatgttctttcagggttctcttccatagtgttgacaatcctttccatagtgtaccatgtttaatgagcctcaaaggtccttataatcctctggtctagaggctgaattggagacattgtgtttggggggaagtagaccacttcgatgactttgatattgaactcaaagggttttgggcagccagggacattactcaataccaaaagaactttaaaaggcagtcccctactggcaaagtacttcctcacttcagggacaaagcactgatggaaccaatccagaaaaatgattctcattgtttaggcctttttgtatgaccaaaagactggaagctggtgtttatcttttcccttgaaggcttggagttaacagctttatagataaggggagtcctggtcaccaacccaattgtatttgcaaacaagtggagtagccttttccttcctgcattagatcctggtgctcactgttattccctactaataaatgctctttgtggcttttgtttccagaatagggcacttttgtctgcattaaaaacctgttcaggcagatctttctcctcaatgattatcttaatggcatcttgaaactcatctgctgccttttggtttgaagaacatgcttctcctgttatcttgacagttttttaagccaagtgcttttctaaaattatcaaaccattcttttctggcattaaattctccaactttcggtccttcaccatccttttgctttaagttgtcatctaatgactgttctttttctcaaatcatttacagtctataggtatgactttcttatagcaatcctgcacctacataaaagctaagttttcaatacaagagaatatgtattttgcaaaaagcacaaggttttttcacctgctggtttagctacagtgacaatttcatgaattttctttttttttttttccacagtagaccttgggctggatttatgtatcttgaaatggtgggcaacctcatctgcaatcctgaatctatggtacatatcaagcaattcaactttttcttgtaattttgtaacttttctctgcttcttggaaggactttcagcgtcactcatggcactttgtatggattccatggtgctattcaaggtttacagtattgcagtaaatatgatgaaaaatatgcaaaactatgggacatcactttttactgtgatacactatttgctgaggagatgaacttctcatgtgaagatgattagcatcacatggcattttaagcagatactcagaacacttgatagcaataagaggtggccatgaatttattggagtagtgcagtagttaatatagttaacgttacgcagttatgatttaacattgcatgtttacatttgtgtacatttctcttgactttgaatgatgccatctatggcccatgaatgtttgtctgcttaagtttcaataaatattaaattttcataaaatattcatacacattttataatagtaatagacaaatatctaaatatatgcattcacagcataactaactttttcttaattttttcaatatttctaggctgcaattttctcctgtgaattttttcaaattattgcaaatctcaaaaataattttaaataaatttattggaaaaaatatgcatgtaggaggacccaggcagatcaaacccatattgttcaagaatcaattgtattttgagcatgatccaaagattgtcttcagacacttttcttgattctaagaatttggtataggcaaggaaactgacataatataagcagtgttcacttaaaaattacagtcaaatatgcaaagactctagaattccataaagctttagagttcagggactgcagttcccaaaggatgacctcaggggtaatgagtaggattactgtgggacctcctaaatcaagtataaatcaaagatgtataagatatcattgtagtttgttgtaaaaaatttattagatattatcattgtaattactacacagaactcctgcttgatagtgttttgtatgtaataagtgcctagtagatatctgctgaatttattcattttgggaccctccatttgttgaaagtctcatcacccacaggacatgaggatcttttagagaaacagacaacacaatgtaaatttagaatcaggagtgcgagtccccccagtttcccagaggaataagtactctccaaagagtgcctccctaatggaggtaatcattgtctttaccataatcctctgcactatcatcatttccctttattgagtacttacttatgccaggccctctacaaacattatcccattcaactcttatcataaccctggagggtacaactcaactccatcacagatgaagatttggaagcctatggtgggtattgttctctccattttacatattataaactgaaactcggagaaatgatgattacttaaataactcaaatagtaaaatgcagatccagtatttaaataatccagatcattccacctttaaatccaccaactcacacagtttcacagttaacatggggaagaggggaaaagggaagtatttttaaatttcattttcatttatattcaagaaaatttactcattttggttacagttctataaattttggcaaatgcataacatcatatagcatgaccacaatcaatatacgggatagttctatgatgggcaccctgaaatttcctcatattgtccatctatatagtcaaaccctttcacatctctaactccttggaactactgatgtgttctttgttcctgtacttttgccttttccagaatggtgtataaatggcatctacagtatgcagtgttttggtctggcttctttcacttatcagaaaaaaatctgagattcataggttactgtgtgcatcagtatgtgtgaaatgcatctgtacatgcaccatcgtttgttcatccattcaacactttaggattattttgctcctagaactagtggtcagcaggctgtcagccagggagcctcagttttcctctacgttgcctctccaacagcagcatgggctcctccacatggtggtctcagtgttctcaaagcgctgggtacaaaagtacttgtgtactgagacttctcctctcttgcttgcgggtatgtttacttacatctaatttgttgctatatatgggccaaagagagtcacttggacaacccccagaattatgactccactttttgaaagcacgtgtgagaaagtcacattgcaagttgtgtgaaatcaggtaaatggcttattactctcttcaaatctcagttggctgttctgtgaagtagttataataacactcacctcttaggattgttttcaaaactaaaaaatgtttaaaaatgaaaagctcctaataaaatatggtcttttcataaatagtgactatgattatccttggagtatctggaaagaacagtgttaggcaaaaaacactaaattacacagaacgtgaagaacatgactcttccctataggaatactagttccttattgttctacgatctcaatgtatgattgcaagttaattatttgatttatttctaatttttaaaataaattacaaaataagcaataaaaataatgaatacatgaaggatttttaatatgacaaatcttgctttacaacctaataaggttattagggataaagttaaaagcattattaaaatacacattattattagaatgggtgacatggtaacgcagcaggatatggttcaatgcctgttggtcttagaagaccagactttgagcaccagctttgccgtgtaatctatggccatgagcaagttatcttacctttctaagtctcagttctctgatctgtaaaatgtggcttacacagctgatgcaactgacccccatgttattgtgaggacccagtgaaatagtatacttggtgtttccgaattgatatatgagagagagagagagagagagagagagaaagagagagagagagaaatgataacactttataatagattatacttcttaaagaattgggataaacatgaaaggtcatagtgactatactatagtgttttattaatttataggatcatcttttcggatagtcacaaatactacccaggccaggccaggcagttgacataattgaatgagtgtcatacaacaggaaatggtatatcctgtagtaaataagggagtttttgtcccattaaaatcagggaatcatcaaccactgcttagtttaatgaaatgaatcttgccacatgggagcgtgggccacatggtaaaagggcccatgtggtttttcaataaaactggaatattagagtttcggatggagttgttatctcaaacacagagctaataaaataaaaatgtagcaaaaaaaaaaaaaatacatggtagattcagcatgcaggctgccatttttgacctctgattaagtcactgtcagctgctttctgcatgtaaacacccatccacattgaacggccatgtgaagcaagctcagcagttcatcttaccttgagcattgatgcttacattcagaaaggacccattatattatggaagatacataagacatatgaaagaatagatcatgtgtgttcatcatcaccttagtttctgttaattaggatcctactcccaatttggaggagaaaggtgcagtaacttttccattgtgataacattcccccaagttggtacatattttggtgatgcctctagagctttgagaaagtcacttaaccacgttccttatctttaaaatgaaggcagtagattagattaaatctacagtgattttcacctgtaatattccatgagtctacagtgagattggtagtaaatataatttcaaacataattttcaacgtgcttttctgtcttatcttgaaaaagaaaagcaaaaaactctgcttatggcttcttgttatcttagcaaatatcctgcaacaaaatattttccttttatatgaatttttaaaaattcattttcaaacatcttcccataggccatggtggttttagccatgggtaaatttcactcatatgccttactatgtaatgacattgtggagtgtaactggctttttaacaccgttaaataattttccaaaatgttttattttaaatagttacaggccaccatttactaatttggtgctaaaaaatttaaaatatctgcttcatgtgaatcaacatttacattccaaatattagtgtgaaaatccacctgttatctgaaaggccttagtttttagaaatgtatttgggaccccaaaattgttcttctgtttcagattatgtttatatctgattattcctaacatataaaacctgttagattgccttgtctttgttcatctaaaatttagctacctccaagctaatagttgaagattatatttgaagcatggatttatttcatgatttgaaaaacaaagctaaggaaaaaattgtttgaaattcttgttcattgcctattcaggccctagcaaaggtaatatgtggtaacaaatggggatgggcagaactgccaagcatatgtggattaactaaaattcacatttaattggctacttttatcaaaccctggccgtgatattgaacaccaagtgctactttagacacttgacaatcatgatctaaaacgaccatgtttaaatggttttttaaaacatccatcaaagttgcattatcctaatgttaaaattaagacatcagactgagattacatacctttctaattactatgtcttcaaactgggatttcagccggctctggttgctgtcgggtctctgggatttccattctgccatgcgtgctgttgagtgtaaggtgcaccattggcctccagggttttagtgtttccagttgtaataaaatctctagttgaccaagaactctgtggttaaataagcaattgggtcatcagctttattaatgggccagcccagtgcctcacagacccaaatacaggccccatctgtggtaaaaatgtaaagaagaccagagcaagccctccagggagcagcccgtattgagctcacctgcttttctgtgggtagagaaactgaagggcagccagcctgtctgcatggaggtcctggagagggaagggagagctgctgcatgaaaactagaaaggcagcctgaatagaacttcatctacaggaaaataagagctgcaatgtcataacatgtactttatctaattttacttttattagataaataatatttttgtatatctatggggtaaaatttggtgtttcaatacatgtatacatggtggaatgatcaaatcaggttaattagcatattcatcgcctcaaatatctatcatttatttgtggcgagaaaatttaaaacttagtcttttagctgttttgaaatggaaaggattggaagagcaaaggaggtgctggaagacatgacttttatattaaggccaaagtaggaaatgaaaagagagaaaggtgtctgtgtctggccatctcagggcagcctctgtcacatcaagctgagggaattcttctctgggcttcctgctttttagggtacagaaaaggtttaataccactgaataattatcccattgctctttctgacatctaacaataaatatatttgcagaaagggaaaactgagtaagtttgtggatctatgttgcctatctgggtataggagtacatacaggtgggtatgaaggatggatgattcaatgtttctgcactccaaaaaatgcagagtaactgtttattatgtggcttcctgatacagtttggtagagaatgcaattaagtgtccaggccttgtgggtgtcatttagggctcagtagcagtagtgccttatcttagataattaatgttgttttatctagtttttgttgttgttgatgttctttgctctttgtttgtgtttgagaataatggacattcagtccaaactgaacagagagcgtactttgcctttatagcctcttcagggacagacagtcttgggaacaagtcacctgtgtagatatatgtaactttttctttcttttttttaaatttaacttttaagttcaggggtatatgtgtcggcatccctgttatattggtaacttgagatataggtaaacttgtgtcatggggttttttgtgcaattattttgtcacccaggttttaggtctagtacccattagttattcttcctgatcccttcctttatcccactccccaccctccaataggccccagtgtgtgttattcccctctatgtgtccatttcttctcatcatttagctcccatttataagtgagaatctgtgttctttggctttttgttcctgcattaatttgctaaggataatgtctgccggctccaaccatgttcctgcaaaggacatgagcttgttctttttttgggctgcatagtattccatggtgtatatgtacaacattttctttatccagtctatcactgaagggcatttagattgatttcatgtttggctattgtgaatagtgctgcaatgaatataaacatgcttgtgtctttataatagaatgatttatattcctttgggtaatacccactaatgggattgctgggttgaatggtgtttctgcctctaggtctttgaggcatcactacactgtgttccacaatggttgaactaatttacactctcacagagtaaaagcattcctttttctccacaacctcatcagcatctattgttttgtgactttttaataatagctattctgactggtgtgagatggtatctcattgtggtttggatttgcatttctctaatgatcagtgatgttgagctttttttcatatgattgtcggccacatgtatgttttcttttgaaaagcatctgttcacatccatttacccacttttcaattggactgtttgcttttcttcttgtaaatttgttaagtttcttacagatgctggatattagaactttgtcagatgcatagtttgcaaaatttttctcccattctgtaggttgcctgtttactctgttgatagttctctttgctgtgcagaagcgctttggtttaattagatcctgtttgtcaatttttaattttgttgcaattgctttttgtgtcttcctcatgaaatctttgcccgttcctatgtccagaatgttgtcttccagaaattgaaactagatttcttccttatactatatgcaaaaaataacttaagatggattagatacttaaatgtaaaacccaaaactatatgtaccttatctttggtatcctgggaatttttctgaattgttttgtatagccaagtctcccttgcagcctcagtggtcaaagggctgcttttatttgaaacagtcctttagaagagatataaatgaactggtactaatttagctgagaaaaacaaagatccaatcccagctgtgaaataaggtcaaagtcataagacaacattacataaaacgatgagcatttaatattacactgggaaatagaaaaatagataaaagatgagaactagagaaaaaggcagcatttaaatagggacaagtaatatgggcacaatgaaagaagaagagaaaagatacatagaaatggaataaaataggaaaattgtgagattctctggataagaaatgaaaagcatatgtaatattattttaaaatagattttagtgaaaataaaggcaatgatataagtaagggaaaatggcagtttttgaaatataatttacagatcacgatggataataagaaacgttatctaagtttttgaaacctctcattgtttaatgcattatgaagatgaatgtgtgtgaatgtgtgggtgtgtgtatgcgtgtgtgggtgtgtgtgaaaaatattagactcatttaggaaatatacagagcatcaaaaatgtcacacacatcttgttatgtttcatgaaataatattggtacctggctcattctgtctcaactggaataatttatctttggtgtattaatctctgaccctctctcaatgacgacaacaacaacaatgacaacaacaaggaaacattcactagacaacataaggaagttctaattaaagccctaaaaagtatttagtagaagaaacaaaattgacaaactatcagagctgccaaatatttaaacattttaatagaataagactatgaaaaaaatgtataggaaaactccatgcttttgaaattgttattactggtcattttactctgagtaagagttaagtgtattggcaatcacttggcttcacagtaatttaaaaccaaataaacatgtaacaaagggaaatatatttattatatcatcataaagagcattttggtaactataaactttaaaaaatgtgtatgatttgaaggagacttttgtagtggagtgaagctcacttttattgccaatttgtaagtttacaaacataatttaaataagttttattagtagtagcaatgagaagttgaaatattgaaattttgctgtattttatatatattttactttggctatatttatattttggctgtattaacttcaaaaagttatctcgcttacctggccacttcattatgcaaagaaaagcataaatgtattatattcattgaaccattaaatgggagcctagcaaagcaattaaaattaataggtcattccagaacatgatagatatagtatgaaaaaaagaaaacctgtgttgattagctgtcaaagtgttgcatctgtttgtcaagatgaacagagaagcaactatttttagtaactgtctttccatttttatcatcataattcatatggtcttgtcattttttaaaactgcagattagaattttttaaatatttcaaataccctcttcaaaaatactacaaataaaatatatgacttagagataaggaaaattaattttatattcagcattctcagtctcctggactgtaacagcagtacaaatcttcatgttgataatgtgcagaagtgttggtttattggcatgaaagtttaagtgaaaggttaagaaagattaacatggtgcaggtctctaaatttcagtagaatcgctggtcatacttagtggaaaacgtaaatgaaacattattagtttatgaagagacaccagagtattgcatatccatgatttttcttaaagaactaaagtgtttacatttgtaatacaatattctatggttggtattgaggaaattgataaagatttctcccagattttcttctaaaagctttatagttttacctcttatatttaagttgataatcaggtttgtatactttttgtgtatggtatgaggaaagggtcaaagttttttttctatatttatattcatttattctaaatccatttattgaaaacacgatcttcatttcattgaatttccttggtatctttgttgaaaacccatctacaatataataattgtgggtatatttctggactcaaaattccttttagttgatctttatgtcaatccttatgccaatctcatactccttagagtgcttttattgtaaatcttaaataccagctaatttgattcatctgattttgttttttcttaaaaaaatttttaagcttttctagattatttgcctttccttacaaatattaacattggcttgtcaaattcttatatagagactgctaggattttgattctgaatgtattcaatttatagtcaattctggaagaattgacctcttaaaaatggtgaattttcaaattaataaaaaagtatatatttccatttagataagccttaactttttaaagcaatgctttagagttttcagttcacagacattgcacatctttttgttaaatttatttgtaagagtttttctttttatggtatatgctgtagttaattaaaatttgattttattgtcaggttgtttatttctggtgtataaaataaaattgatttttgcatgttagtttatatcttgagaatgtgttagactcattagctttaggaagctttatattaggttctttaagattttctacatacaccatgtcatatgcaaataaatgcactattgttacttccattctaacatgtgcctttcatttatttcttttttgtcttgctatacttgcagcggtgagagtggacattctttgcctttttcccaatttcaggagaaaacattctgtttttcatcattaaatatgaagttagttttacatttttcatagatacgctttatcaggttaaagacgttttcctccatttctcattacatttttttttaaatcatgaatggtgctgaatcttgttaaatgttttttcttcctctactaagataatcttacagtttttctctttattacatttaggtaatatgcttagatacgttacatttatataatactacatttgttaaccttcggatgttaaaccaactgtgtatacatgagaaaaattacatttgttcttggtgagttattgtatttttttcttgactgtaattgctattttttttttttaatttaaaagtaaactttaatgtcaaaatgcaaacctggggagggcataaagatcacacacaaggctgccacttcacacttggagggttgcacagtggccagtcaaaggcgctcctcacttcccagacaatgtggtggccagacagaggtgctcctcacttcccagacctggcggcagcggggcagaggcgctcatcacttctcagacggtggggcggccaagcagaggtgctcatcacttcccagacggggtggcggctgggcagaggcgctcatcacttctcagatggtggggcggccaagcagagactctcatcacttctcagatggtggggcggccaagcagaggcgctgctcacttctcagacggtggggcggccgggggaggcgctcatcacttccccgacggggcggcggctggacagaggcgctcatcacttctcagatggtggggcagccaagcagaggcgctcctcacttcccagacgggtcggcggccggacagaggcgctcatcacttctcagatggtgaggaggccgggcagaggcgctcctcacttcccagacggtgggtcggccaggcagaggcgctcatcacttctcagatgatggggcgacgggacagaggtgctcctcacttcccagacggggcggcgacgggacagaggcggtcctcactttccagatggtgcagcggacgggcagcagcgcccctcacttcccagaccgagggaggtgcggggagaggtggccaggcagaggcgctcctcacttcccagacattgcgcggggccgggcggaggcccccctcacttcccagacggtggggcggccgggcagaggcgaccctcacttcccagaccgagggaggtggtggtggggggtggcccggcagaagcgctcttcacttcccaggcggtgcgggaaccaggcggaggcactctatttggtaatatctttaaggattcatgaaaaaaaagtctatgaaacaaacaaattgagaatcgtcccattgtacagatttaaaattattttaagcaagagacttttctttatagctaaatatctaaatatcagagtattttttgtagatgcttatgtaaattctggaacgttgttttcaattttaataaagatatttatccaaagttccacacacatccacatatccacacacatacatatatatcctgatatctatcttcattagcaacatatcttaattatacatatatcttaatttgatagatatcttaagcttctctgaagtgataagtagatatagatctcaattagatatacatattagaagatagaaatacttgagcaattgatcaatagaggttctgctttttaaattaaaaaagtagttgcatagctatttttaaatgttaattattctttcaaagaaactgatgaattttcctgttaaaaaattgtaaaatgtgtatttaaatcacccatatagtgaggcttaagtctccagatttattactttatgagctaccagaattatagaaatgtggcaatttattttgaagaaaaaagaggtttttaaaaatgtactaccacattattttaatagcacactatacagacatcagtacttacagggaaaaccttaatcctttagtgtaatgtttagtgttaattatgtctctctcacacacacacatgcacacacacactttcttagagctgctttatttttatcctcagaagacccttatgcacaaaggtgattgtttccactatagaagcttcccttgtgtgattatttcccttttagaatcttaggcagttcagtttagagaagtcccctcaaaagcccccttcttatttggctaggccgcaacccggtgcctaagcctatactctccttagtgtatcagtgctcttcaggacaattatacaatgaaaagcttaggcttttcttacaaaggcagtttatactggaatgtaaattaatttacagaattaattctcagatattccttgtattaaaaggacaaggtatttcctgggcactccatagcttaagataccaatgtgtttatcatagtatttttatttcactttttgcttaaacaattgtggctcttaatttatagtagaataaatttgatgtgtgtgttaactttctactaattaataacctgataattttagccctacttaccctgtctattctgctaaaccaaattacaaaatttacactttactcctatgacaagttcttcattattttgcccctgtaactattcttgtgttaatcactattaggaaaatgtcccctacctatcacttcagagaagcttcttattgcggctttgtttcccaggtaccaggttataacgacttactttggtatttgttataccaagtgattgtgatgtctgaacttccctgacctcagtttatcatcagagggaaaaaggacaaaagcccttgagcgggcagtgatatacatacaggttttaacaatttattgtgcacgacagatgtaaactaaatattatttaggatattgggatatgtggggtgttctttggggtgttctagaagaatcatcttaaaactctcccagcacaaaagtggtgtgtctgttatcagtggtgccatcacagatctttaaggttttaaggtttaacaggaaagccactggcctcagtgctcgaaggaccactgatccttgctaccaccctgatatttaattagaggagaaaataaactttatcatcccatttgtgccttttattatctttttccttaaaaaaaaaagcacaatgaaccaaaacttctaaaattcacctttttttttcttttggtggaacaaagatgtgttagtattagagttgtttattttgtttaaaggatttctatcttgaagtatgtactttgttttcctcaggagcacaaaccactctacagacaataactcacttagatctttcaaattctgcagagagttgtaggtgataagtagtatatgcaatttacagggaggacaattgaaatagaggttgcctctaattgctcagaatcagaaaccacaactataatggaattcagaatagaatctgggtctcttgactcccaattagttctctatccactagatcacactccctactcctcagtccttggaaaatagatggtaaattttacataaggctaactctgaattacctacagtttgtaatgagcgcctacagatgctggtttacattcacatcattgccctggagtcggcgctacggcatctgccagaaacctgtggatcagctgtcttgtgctactgtggcaaagccaggaagaaaggcaagcaggaggagagcaaagggagcagaaagagtttggatgtgggaaacacagaacttataaaaatcaggggaacattaatagttgtggagttggatgtcaagactatgccaccatctatgtttgtgcagatggagacaaattgagatggaattccatccttatacatcattttccacatacaaacatggacactaacttaagggtaaaactggtgggagaggggtgcaggcaccatgtctggccacgaagctggcaagaagccccccaaacagcccaagaagcaggctgaggagatgaacgaggagataacattttcaagcagaagcagaaagaggaacagaagaaactcaagaaactaaaagcagaggctgcagggaaggggcccctgggcaaaggtggaattaagaaatctggtaaaaagcaagctgtttcttgtgccggaggccatggtgaccctgaattccatccctatttaaacatctgaatttcctgctgtaacatcctttgccacctatagttagaatgaagtgtcatcttagagcctgccgcacatttaagaataaacttttgtaaaaataaataaaataaaaataaaagcaaatctaaaccacaaaataagcaagtaacatgaaaactagagctttggcagttctgcaagaacttccattgcataggcagatttcatgtaagctgttgaatctctagtatcaatggtatggcatgactgaaagtacatggtagtaatttaaaagtttccaagtgagaatggtgacaaaacaaacacgttacaagcctcaatagggagattattcacataggtagtatttggacatggtgtcttgcagcaataaactgtagcgtgttcactgttagcagagtgaactgttactgtcctgttttagttatgattgtctttattttgattactcagaaatttctaatatatcttcttgaagatcagagtgggttgtgatgttaaatataagaaattataggccgggagcattggctcatgcctgtaatcccagcactttgggagaccaaggcaggcagatcacgaggtcaggagatcgagaccatcctggctagcatggtgaaaccgtgtctctactaaaaatacaaaaaattagctgggcgtggtggcacacgcctgaaattccagctactcttgaggctgaggcaggagaatcacttgaacccggaaggcagaggttgcagtgagccaagatcatgccattgcactcccgcctgggtgacagagcgagactccttctcaaaaaacaaacaaaaaaaaattgtcaaaatttatatgggataaaactactcaactttttttgtttctattatctggagatatttacatcatttttttcagaagataaacttaaggcatgaaatacatgttcagggcagggcatggtagctcatgcttgtaatctcagcacttcgggaggccgaggcgggtagatcgcttgagatcaggagttcaagaccagcctggccaacatggtgaaaccccatctctactaaaaatacaaaaattagcagagagtggtggtgggtgcctgtaatcccagctacttaggaggctgaggcaagagagttgcttgaacctggtaggtggaggttgcgtgagccaagatcgcgccactgctctccagcccaggtgtaagaggcagcctctgtctcaaaagaaaaaagagagagagagagagaaagaaatacatattcagtgctgagatttgcttaaacaagcaacaattgtataaaagaagaaagaatggagagtgtggtaaatattgaaaatataaatgactatgtgatctctcaaaggagcttttggtacaattcctgatgaccagaatgtatgaatctcattaactacaccttagaatggtgcctggtgcatagtcagctctcagtaagcatctgcctaaatgaaagacatagaaaagccagctttcagtaagttccaggatgcaagagcagtgaggaaatggagagagtcattatcaaaacatcagctaacatgcttgaagtaaggaggaaacatgaattgtctcagagatgtgcaagcttcttcacagagttaaaaactgagacaatggtctaatataggggagacagtgtggatgacacaggagagagagggacagtatataagacaaggctcctgaacatagaggggctaggacttccagcagaagtagagagtttggcttacatgagaggaggaacatttttttgttttgttttgttttgtttattcagtagtgaagggaaaacaagagatcacaattcaggctagtcagttgtgagagttcctgtgtggtagatgctatattttcttttttttttttttttttttgagacagagtttcactctgtcacccagactggagtgcagtggtgtgatctcagctctcagcaacctctgcctcctgggttcaagtgattctcctgcctcagccacccgccccccagtagctgggattacaggcctgcaccaccatgcccagctaatttttgtatttttagtagagatggggtttctccatgctggccaggctggtctcgaactcctgatctcaagtgatccacctgcctcggcctcccagatttctggcattacaggcatgagtcatgacacctggtcaaatgctatattttctagaaatcggatgttttgttaagattgactagaagtatgaaccataggggtgtagaggaagcattgacaaggggagtgtcctagcaattgttgtaggacaggtcttgtgttcatgaaatccctcagcttttttttgtctgggaaagtcttcatctctccttcatctttgaaggatagtttcactggatatactattctacaataaaagttaacagtttttttttttcttttgacactttacatatgtcttgccactgtctcctgtcctgtaagggttccactgagaagtccgctgccacatgtattggagctccattgtatattatttgttttatttctcttgtcacttttagaatcctttctttatccttggcctttggcagtttcattattaaatgtcttcagatagacttacttaggataaatgtgcttcatgttctgtaaccttcttgtacttggatattgatatctttctctaggtttgggaaattctctgttattattcttttgattaaactttctacctttctctcactctctctctctctctctacatcctctttaaggccaagaactcttagattttcccttttgaagctatcttccagatcttgcatgcatgcattattctcatttattctttcttttgtcttctctgtctgtgtattttcacatagcctctcttcaaattcactaattcttctgcttgatcaatgctgctattacaagactcttatgcaccctgcagtgagtcaattgcatttttttaactcagagtttctgtttgattcttttaaattatttcaatctttgttaaatttatctcataggattcagaattccttctctgtgtcatcatgaattttgttgagtttcctcaaaacaactattttgaattttctgtctgtaaggtcacatatctctctctccataatgtttcactggtgccttatttagttcatttggtgaatgcatgttttactggattgtcttgatgcttatggatgtttatcattatcgaggcattgaagagttaggcatttatagtagtatttgcagtctgtgcccattcttcttgggaaggctctccaggtatccaaagggacctgggtgtttttatctaagtttttggttactgcaggcatatctgcattaggaggaaccccacgcccagtaactcgaaggatcttgatgactcctagaagtactgcctttgtggtcttggataaaacctggaagaattcactggattatcaggcagagactcttgttccttcccattactttctcccaaataaacagagtctttctgtctgaactgagcttctagggctgggaaaggcggtgacaccatcatggggactgcaccaagttaggcccaaagccagcacaacactgggtctcacccaaggtccacgataaccactgcctggctattgcctatgttaactcaagtttctagagttctagaatctgctggtggtgaaaccatccaggcttttctctcaaccttcagggcttcaagtgtcccctgatcacagttaggtccagagatgctgtctggcagccagtccctggagtcacaaaccttaggtatcaacctggtgctctttttttattgtggttcagctgacaccaaggcaacaagaaaacatctttcccacttttcccttcactttccacatgcagaggttttgctccccatggtcaccaccacccaagcctgtggtgagtaatgtctggttaccaccaatatttattcaagccccaagggcttttcagtcagctggtggtaaatgcttccaggcctggaactctcttttcagagcagtggactcctctttgactcagggcaagtcaagaaatgctctctaagagccaagacctggaattgggaacctcaagagcccatttggtgtttgatatggtttggctgtgtccccacccaaatctcattttgaattgtactttccataatccccacatgttgtgggagggacctggtgggaagtaattgaatcatcggggtggtttcctccatgccattctcatgatagtgagtaagttctcacaagatctgagggttttataagaggcttttccctttgaacttggatctcattcttctccgtcctgccgccctgtgaagaaggatttgtttgcttccccttctgccatggttataagtttcctgaggcttcctcagccctgcagaactgtaagtgaatttaacctctttcctttgtaaattacccaatcttgagtatgtccttatagccgcgtgggaacagactaatacagtaaattggtaccgcaaaaagtggggtgctgctgtaaagataaccaaaaatgtggaagcaactttggaactgggtaacaggcagaggttggaacagtttggagggctcagaagaagataggaaaatgtgggaaagttgggaacttcctagagacttggtgggctcagaagacaggaagatgtgggaaactttggaacttcctagagacttgcggaatgtttgaccaaaatgctgatagtgatatggacaatgaagaccaggctgaggtggtctcagatggagatgagaaacttgttgcgaactggagtaaaagtcactcttgctcttcaaagagaatggcagcattttgcccctgccctaaatatttgtgcaactttggacttgagagagattatttagggtatctggtggaagaaatttctaagcagcaaaacattcaagaggaagcacgcctaaaagtttggaaattttgcagcctgacaatgtgatagaaaagaaaaactcattttctggggagaaatacaagccagctacagaaatctgcataagtaacaaggagccaaacgttaatagccaagacaatggggaaaatgtctccagggcatgtcggagaccttcatggcagcccctttcattacaggcccagaggcttaaaaggaaaaaatgggccagatccagggctcccctgctgtttaacctcaggacttggagcccttcatctcagccactccagccatggctgaaagaggtcaagttacagctcaggccattgtttcagagggtgcaagccccaagccttggcagctaccatgcggtattggtcctgagggtgcacagaagacaagaattgaggtttgggaacctctgcctagatttcagagaatgtatggaaatgcctcgatgtcaggcagaagtctgctgcaggggtgaagccctcatggagaacctctgctaggaaagtgtggaagggaaatgtggggtcagagcccccacacaaagtcctcactggggcactgcctggtgtagctgtaagaagaaggccactgtcttccagaccccagaatggtagatccactgaccgcttgcaccatgtgcctggaaaagtaacagacactcaatgccagcccatgaaagcagctgggagggggactgtacctgtaaagccacaggggcagagctgcccaaggccatgggagcccacctcttgcaacagcatgccctggatgtgagacatgaagtcaaaggagataagtttgtaactttaaggtttaatgactgtactgttttggactcacatggggcccgtagcccctttgttttggccaatttatcacatttagaataggtgtatttacccaatgcctgtaacctcattgtatctaggaagtaactaacttgcttttgattttccaggctcaaatgcagaaggaacttgccttgtctccagtgagattttggactttgacttttgagttaatgctggaataagagtttggagaacttttggaagggcatgattgtgttttgaaatgcgaggacatgagattttggaggggccaggggaggaatgatatggttttgctgtgtctccacccaaagctcgtcttgaattgtagatccaataataccaacatgtccttggatggagccggtaggaggtatttgaatcactggggtggtttcccccatgctattctcatgataatgagtaagttttcataagatctggtggttttacaaggggcttatgcatttgcttggctctcattcttctccttcctgtcaccatgaaaagaaggaaaggacacgtttgcttcttccttcaccatgattttaagtttcatggagcctcccctgccctgcagaaccataagtcaattaaacttctttcctttatatattacccaatctcaggcatgtccttatagcagtgtgagtatggattaatacagtgctataccctactgtgcctgagctcttacctatgctgtaagacaaaatactgtgtacttttccctgtcctttcctcaatcagtagtttcttcccatggccaccatagctgagaatgtgttaggtcacaccgaaagcaagcacatctctgggtctcacctatggcccatggtgagcactgcttgggtatcactgctgattattcagggcccaaggactctttagtcagcaggtgatgaatcctgctgcaaccgagtccttccttttaaggaagagggtttcctcccaccctagtgtatgtttggaaatgtcactggaagctagggcctggaataggggcctcagtactctgcctggtaccgtatcctactgtggctgagctaatacccaagttggaatacaaagtcctctttacttttccctctcctctcctcaagcagagggaaagagcctctcctggagctgcaagctgagtttcctgccattgggctaagggtggcacaagcactcctttggccacccctgctggcgtctcactgggttgcatccccaccaagttcactggctctgagcccagcacagtaccaagacttgaccaggaattgcagcctttgtggcttaagccacttttcaaagttatgtaggaccacagagtactttattagcctgtggtggtggagctgcaagaactcaggttctgaccactgggattaacaattttcctctagctagggctggcataattgctccctctgcagatgctggctgagttctgcctggtgttactttccactgtgacagagaagcactgagttccaattcagagtcccataatcactgctctctccgtgccctaagcacatagattctccatgcggcagtgctgctgctgggtggtagtggtgtgggggtggtgtggttgcctttcctaccctcttcagtgcctctttcagtgatgtgagctaaaaccaggtactgtaattgctcacctgattactggttcttatgaaggtgcttttttatgtgaatagttgtccaatttggtgttcccatggagatgatcatcagtggatgtttctatttggccaccttgctctgcctcgacattcaagtgttcttcatgagccattctcattttagaagctcactgatttctcttttcttttaattaacaaactattaataatttacaccatacaagttattacttggctgtaaatcatttttaaaccagtatccaattatttgaaatttatgagtctcctttctccaataagaatataagttctttgatcaatatggctcactacagtaaaaccaaggataatttatcttactcaccataatgtttaatgaagtattgttccaaagtttttccaaagagaagtcactccttatacttagtgtctatcctcagtgcctaacacgtggctgagtacatacaaggtattcaataaatgcttgttgaactgatatgggcaactattaaatacttagttcatgcatataatttcattgcttatgctttcaatgtcttaaaatggagaagacctcacctcacctgaatttgtctgctgtaaaatatgaactatgtatgtaagctcttaagagagagcttacataaatttaagaaatatgtgaaagttagatcatgcccaagatttgtttttcaaacataagaaaataaaatacatcactgaaggtataagtcttttatgagtcttttctttctcataaaaataaaagtaagatactttagtcacttttattttaaaacaatatacatttatatttggaagctgttgctttctgggctgtaaaatttgctttatcactggacctgagaaagacctataataataatgttaaaatattttatttcaaagcatcatatttatatacattgagataccatttatgtcattttaatttagacctcaaaatatattttaatgaatctgctgatttatatgaagtctttatgcacaccaaatacttaagaatattcctctattaggtgttcctgtctctaactctgcatctgaaaaggggacttgaatttttctcaaattcttatgtgatcatggcaaattaaaacagacaactctgttgctccatatgtaactttctagaaactctttcatgaaaaatattcatttagaataagtttcaagcaatgtttcaatttgtttcagttgtaaacaagatattttcctgtatcattatcaaattagccacaatgctgatactgtcatcactggctgaattagaatgtttgtaacaatatagacatttgaatgtaaaacatttgcaataatttttctatttaggattcttttactggacatttaggtattaattttaattgactttccaaatattacatgcttactggagaaaaaagaaagtaggtattaacaaagaaaaaaactcataaatcaaccattcagagataaacatattaatattttaatagatttttccaatattttgtgtatatatacagctatatgtatatatatatacacaaaaattatatgtatatgtgtgtatatatatatatacttgcatgctttttttctatcttttaggatcatggtatatagagagttttaaaaaattaacattgcattgaatttattatctgacaagactagatagttgttttttttttttttttttgagacggagtctcgtgtcaccgggctggagtgcagtggcatgatgtccgctcactgcaacctccgcctcccgagttcaagtgattctcctgcttcagtctgtggagtagctgggactacaaggcacgcaccaccacacccagctaacttttgtaatttttgtaattttgtaattttgtaaattttgtatttttagttgagttggggtttcaccgtgtgagccaggatggtctcgatctcttgatctcgtgatccacccgcctcagcctcccaaagtgctgggattacaggcgtgagcccccgtgcccagcctgactagatagttttcaaaaatataatgtttaggctcatgcctgtaattgcattggtttaggatgatgacgtgggaggatggtttgaggacaggagttagagaccagcctagacaacacagagagaccacgtctctacaacatacatatatttggtctatgtggtggcacgtgtccctaatagctaccaggaggctgagacaagaggatcacttgaggccaggagttggaggctgcaatgagttatgctcgcacagttatccagcactctacgctgggtaacagtgagaccttgtctctaaatacatatatgttacagagtgagaccccataggatcgcactgtattatagtctatatatttacccatctgcttcatttattttcaccacatattttagatattattttttcccattttccttttatgtaataaactttgaacacaaaattttgaatacagctctacttattcatcacattacttatcacagtagattttaagtggaatcataatctcctaagaatcttgatcaacactttcaaaatatatttttaaaggccgtgaaaatttatacatccatctagggccaatagttgtatttctgcttatatgtgaatatatacagcccttggagttgtgcagtatacagcccacaagactgaactggtgattttactctcacctgtagagtatgactgtacccatctcactccactaatattaaatgtaataaatttaaaattattaatagtatgaaaggttaaaaataaacatgtttcttatagagcactaaagttcaattgcatttagcagagatctttaaaaactgtgttgtaaacattatagacatttatttttttctcacttagtggtttagaggaagtagaggtgattcgtgtctggcagtaggtttttctacaatgtttttcaaagatctctgtggctgttaacttttgctctcacccaccttggtctaagttagtacaccactgccattaccatgtccaaacagcattatggaggaaagtgaaaaagtgaagggaagtagaatttcctttctatttaagggaacaatgcagttttctttataaaaaaaattctaactttgctttaaaaacttctgttcatatccattagtcacaaattagtcacttagacaaatctaattgttagagaaactgggagatgtagtgtttattttgagtttgtcaagacccatctgaaaactaggaattaaatattgcggaaaaaatagaaaaatggttttgaagaattattactctctgccatacagagaatcttacatttgcaatatatttgatcactggtgagattgacattttttcatgcgcttatataatttcttacatcaattacaagttagtgttctgtgctatttttgtcacggaagtgttttttggaaaggactttctgtataatatttatattaacttttttttgttgtttttgagatggagtttcgctcttgttgcccaggctggaatgcagtggagcaatctcagctcactgcaacatccacctcccaggttaaagcagttctccttcctcagcctgccaagtagctgggattacaggcatacatcaccacaaccagctaattttgtatttttagtagagatggggtttcaccatgttggtcaggctggtctcaaacttctgacctccggtgctcctcccaccttggcctcccaaagtgctgggataatagtcatgaaccactgtgcctggcatatattatcggttatactcattttaagtattattcttatactacttttttatttattggaattttacaggcctatgatcacatttttattatcattatacttagaaagtttttccattccccaagatgttaatatttattaatatttcattacaggattaaataaatttagattttatttaaaatgttattttatctttagggtttttgtttgtttttgttgtttgttaaggctaagaagaaaaatatccaacttcagagttttttaaaatacttacttttctttactaatttttaaaattatttatttaacactaagtaaaaattcagaagattttatattgtgctcatatagtttagcacttttttttttggttcactaccttatagtcctggctcactttttattaaatattcaaaaattgtacacacatgattttaaaaagaataaggttatcctcaatatttagcaactttttaaaatgtttaatgagtttttatttttttcaactatttttaagatacagggagcacatgttcaggtttgttacatgggtacattgcactcaggtagtgagcatagtacccaataggtaattttgggaccccctcctcctccctcccttccccctctgtagtctgcattgtctattgtttccatgttcatgtccatgtgtgttcaatgtttaggtcccacttataagtgagaatgtgtggtatttggctttttgtccctgcattaatttctgaccctggttaggataatggcctccagtgccacacatgctgctgcaaatgacatgatttattatttttttgtggctgtgtagtattccatggtgtgtatatgtaacattttctttatcccatctaccactgatgggcacttaggttgattccatgtatttgctattgtgaataacaaggcaatgaacatgtaagtatatgtgtctttttggtataatgatctattttcctttatgtatatacccagtaatgggattgctgggttaagctctaaaattatagaactgaatgaaattgagacgtaagaattgatacaaaagatcagtgaaaccaagaattggtactttggaaaaaaacaaaacaagataagattgataaaccactagctagattaacaaataaaaaaaagataagatccaaataagtgcaatcagaaatgataagaatgacattataattgatccccacagaaatataaaagatcctcagagtatactatgaacaactctatgcacataaattacaagatctagagaaaatgatgaattcctgaaaacacataatgtcccaagactgaagaaggaagagattaaaaccatgaatagaccaatatcaagctctgaaattgagtcagaaaaaaaacaaaacaacaacaacaaaaaaatcagtgaaactgccaaccaaaaagaggcagtggacgagattaattcacagttgaattctaccagacatgcaaagaagagctggtgccaatcctactgaaaatattccaaaaaatggaggcagaggggctccttcctaagtcattctatgaagctagcatcagcctaacaccaaaatatgtcagagacacaataacaacaataacaacaaaagctttaggccaatatccctggtgaacatagatataaaaatcttcaacaaaattctagcaaaccaaatcccgcaacatatcaaaaaatttaacacaccatgatcaattaggctttattcctgggatgcaaggctggtttaacatacagaaatcaataaatgtaatttacaatataaacagaattaaaagcaaaaacatgagatcctttcaatagatggagaaacagcttttgataaaatccaacatcccttcatgataaaaagcctcaacaaactaggcatttaaggaacatgcctcaaaatggtaagagccacctatcacaaacctacagccaacatcatattgaatgggcaaaagctggaaccattcattcctcttgagaacttggaacaagaaaaagatgcccactctcaccactcttattcaacgtagtactggaagtcctaatcagagcaaccagacaagagaaagaaattaaaggcatcgaaataggaaaagaagatgtcaaactatctctcttccctgatgatatgattttatatctggaaaacccttaagatgatgtcaagagactactagaactgataaacaattttactaaggattcaggttacaagacagtgtacaataatcagtagcatttctatacaacaataattcctggctaagagtcaaataaagaacacaattcccacctctacaatagcaacaaagaaaatgaaatacctaagaatacagctaacgaaaggggtgaagtatttctacaaggagaagtacaaaacactgctgaatgaaatcagagatgacataaacaaatggaaaaacattccaggcttatggattaaaagaattaatatagttaaaatggccatattgcccaaaacaatttacagattcaatgctattactaaaaaactaccaaagtcattcttcgcaaaatgagaaggaaaaaaataaaagctattctagaattcatgtggaaccaaaaaagagtacaaatagttaaagcaatactgagcataaagaacaaggccaaaggcatcacactaaccaaattcaaactatactataaagatatagtaatcaaagtagcatggtactggtacaaaaagagacacatggactagtggaacagaatagaaaatgcagaaataaagctacacatttacaaccatctgatcttcaataatgctgacaaacaaaaacaaacaaacaaaaaaaaacagtggggaaaggtcttcctattcaataagtggtgctaagataaccggctagttatatgcagaagattgaagctggacccctacctttcactatatacaaaaattaactcgaaatggatcaaatatttaaatgtaagacctcaaactataaaaattccagaagaaaatctttaaacagacaatctacaggatgggagaaaatattcccaaactatgtatccaacaaaggtctactatccagactctataaggaacttaaatcaataagcaaaaaacaaataaccttggctgggtgcggtggctcacaactgtaatcccagcactttgggaggcagaggcgggcggaacatttaaggtcaggagtttgagaccagcctggcctcaaactgtttagtagagacatggtgaaaccctgtctctactaaaaatacaaaaattagccgagcatagtggtgggtgcctgtagccccagctactcgggaggctgaggtaggagaatcgcttgaacccaggaggtgaaggttgcagtgagctgagatcgcaccactgcactgcagcctgggtgacagactgagactccgtcaaaaaaaaaaaacaaaaaaaaaaaaacagcaaaacataacaacaacaaaataacctcatgaaaacatggggaaagaacatgaacagaaacttctctaaagaagacatacaagtggctaccaaacatatgaaagatgctcatgatcagtaatcatcagagaaatacaaattaaaaccacagtgaggtaccatatcacaccagtcaaaatgactatcattaaaaagtcaaaaccgacagatgctggccaggctgtagataaaagggagcacttatacactgctggtgggaatgtaaatttgttcagccattgtggaaagcagtttggagatttttcttagagtttaacatctctttaaggactatcagttctgttttgttgctttctccagggctggtgttcagtaagcacacatgtctggagtgtggtatattctaccaggatacattctgaatatttgggacaactgccacaccacttgttaaatatttttgactatcacccttgggtttattcattggtttttgcctgagcctcacattatgtaatttttctaccttattatgttgaattattaagtgtttttcatatgtagagggtattcaaagttcaatatattttaaggcattatttacaactttggtttcccaattccattttaatcaagagctaaataaatagaggctaatgtcaaaactcggtgatttaaatctctaaacacattcaaggaaaaaactaaagtataaaattcaaatcacgttttgactaagcttattttcttcataaagaaaatgttcagctgtctcagaataaatgtacattttaataaataaaagatatcataatataggaatgtctttatattactttagcatactttaaaccaacaccaaaataggagatgatataacttatgatttattgagttataacttcttattctaattccaaaatatttaattttattgccatatgctttcacagaaagccttatgtgattttgtttttttaaactgtttctcattaatattagacataataggaacttatttatactattagacatagataataaattactgattagtaattgaataaatcagcaatgaccaaaatctgaagtaaatgttgataaagcttgggaatatctttttgtacttctgtgtgcatacgtatgtctttgatttgggactttttgtaaaattaagccacctgaatactattcaggatgagtaaagacattttctatttatctaccttatgcctgcattccagccttcagtacagactatatttaccatagattgctttattttaagctgtataataagattttctttaaaatgtgttatttctgtttcaatgggattttctgtatactgtgtaaataaaaggagctgcattataaatgaagcaaatacaattatggttgtcaagacacttgaggatttgattaagttttcaaatattttgccatttacattgaggaatgggaagtgtggaaaaaaatcaacgatactgttcttttgatgctttgttttagtgtataatcacctcttaataaaatgtgttgtgtgacagttagcaacaattctgctgttcgtggcgttaatgccgaagatctgataagaggagttgcaggagtgtgaaaaatgagtcaacttttctagatattttctataaattggatccaataaagtacaataaatatgtcttcaactggtcttacaaagcttttatctgagttgggtacaggtaaaaagaacagtatctcgtgaaatctctgattgttccttttgtttcagggtcttagtcagcagtcagtatttaactatgatacatgaaatgttatttcttttaggttagaggtaatgagaaaaatcaagaaatattaggaaacatgttatatacagtagtaatttatcattaataatttgtaaatattatcagagtgaaaattcagagactgacaagggcatttacccagcacactttcaagtcaatcattcactgtgtaggattaagatcatgtgttttgaaactcatgtattttgagttgaatctcaggcaactatcagactgatctagatgtcatcttactcttctgtgaattgggaattaattagaaatattatatatatatatactatattatattacataattttatactatatatactatattacatataatatatattatgtataatatataatatactatagtatatatgtattatatactatagtatattatataatatatattatattacaatatactatagtatatatattatattattttatatactatgtataatatagtatattatatataataaatataatatacactatagtatatattatatactatatatatttatatatatctacttaataggcttgtaaagcttgagatgataaatagatgatgatgatgatgagagagatcagaaaagtctggattataataattgctaaataaatagtaattcttcattattagcatcatcatcatcaattgtctacatagttgtcaagaagctgagcatcttggcttgccatatttttattttctaaaataataaagtgattaatgatacattaaaagctaatattaactgcatatagactccactctttcaacaccttcattttttaattacaggttacatattacggatgatttaaggttcagttttgcattaaagcacttgttgatgtgtatgcatatcctacaaggacatgttgaatataatctacatttataaactatagaaactacttcttccttttgcaggtacagatgattcattataataattttattaagaattattattattattattattattttgagacagagtctcgctctgtcgcccaggctggagtgcagtggcgcgatctcggctcacggcaagctctgcctcccgggttcacgccattctcctgcctcagcctcccgagtagctgggactacaggtgcctgccaccatgcccagctaattttttgtatttttagtagagatggggtttcaccgtgttagccagatggtcttgatctcctgacctcgtgatcctcctgcctcagcctcccaaagtgctgggattacaggcgtgagccaccacgcctggcctaagaattatttcttttcatactcctgaataatgagtccccttttttctgcaccctcactgccgtgtctaaggtcttgatcttagcctttctgggaaaatttgggggctcataaagacatctgctccactctttgccttccagccgtctaccatctacaattcatactcattaaggattcaatagctgtattcagtcaatatgtttcttcctctaaaataatggcattttagtttcttatagttttgtgagggtgaagaagccctagatgttttctcttgcattattttcttcccttgccttggctttccgtttttattctccttcaaaaaagttttcatttttctctagatggtctcctaatgtgtctcctttcagacacatttgttagaatgatcttaacctgttctcccagacagcagagcttaacaaaaaagaccaatggctatttgttgaattttgaattttaatttttgtgggtacatagtaggtatacatatttatggggtacatgagctgttttgatacaggcatgtaatgcataataatcacatcatgtaaagtgagatatccatcccctcaagtatttatcctttgtgttacaaaaaatcaattatactttattggttattttaaaatgtaaaattaaattattattggccaggcatggtagctcacgcctgtaatcccagcactttgtgagactggggcgggcagatctcttgaggtcaggggtttgagactagcctggccaacatggtgaaaccccgtctctactaaaaatacaaaattagctgagcatggtggcgcaccagtaatcccagctacttgggaggccgaggcaggagaatcgcttgaacctgggaggcggaggctgcagtgagctgagatcacaccactgcactcagtctgggtgacagagcgaaactccatctaaataaatatatatatttatatatatatatatgactatagtcaccctgttgtaccatcaaatactagatcttattcattctttctattttttcacacccattaaccttccccacctacatctccatcctcctgactacccttgccagcctctgataaccatcgttctgctctctatctccatgagttcaattgttttgattttttagatcccacaagtaagtgagaatgcaatgtttttctttctgtgcctgggttattttacttagcataatgacttccctttccatccatgttgttgcagataacaggatttcattctttttttagggatgaatagtactccattgtgtataagtaccatactttctttatccattcacctgttgatggacacaagttgcttccaaatcttgaatattgtaaacagtgctgcaacaaacattggagtgtagatatctcttctatatactgatttcctttcttttcggtatatacccagcattgagcttgctggaacatacggtagctctatttttagttttttggggaacctctaaactgttctccatagtagttgaactaatttatcttcctaccaacagtatacaagagttctcttttttccacattctcaccagcattttttattgcctgtttattggataaagccattttaactggggagagatgatatctcattgtagttttgatttaaatttctttgacgatcaatgatgctgagcatctttttatatgcctgtttgccatttatttgtcttttttttgagaaatttctattaaaaccttttgcttatttttaatcagattattagatttttcctgtagaactgcttaaattccttgtatattctgcttattaatcccttgtcagatgggtaatttgcaggatgttgttttattaaggaatacaatcaaaaaagagaggatgaagaacagtggagtgaaggagagaagtgagaaaccaatgagatcaaattctattttgagtatgatattttggtatctccttaaatttttcatccaaagcaagtgcttcacacctcactcacctctccccagttacagccctgattgaggtgcattatcagtccagctgccagcaagtgcaagtggttgtctgattcaggaactctgttccctgagaagtgtagactgagtcttggaatcacccataagtggggagtaaagggtacctgtgtgaagatggtcaaaaatcatagagctatcataagaggcaagtgaatctaaggtgtgaaatggtgactaagatatgtaaaattagctcctcacacaactcagctacttgagtgtccaccattatatctagctctcataaaaaagataggaaaaaaaattgtgcttacttcttctctgatagagatgaagtaaatcaattattttcagagaagttcctttaaggtagtagccagctgcaccccctgaaaagttaatgcaagtgggctaggagatagactattgctcccatggctgtagctggtcctggggctgcaattgatctttgcgatctcccctttctaccacccagtctagattcccttcacccttagcaattctttgactggtctgagtggcttgtctcatggaatgatgcaaatcttcatttcagagttgtctaaagtattacatttttcagtgttctggggacgtggttactacattctcaattttgctttcaaaactagaggtagaagcatcaagtactgtcgctttgaatcccttgagtattatttgtctctgcccccattgttaagcagcaaccctgactctttatggtaatcatggaggttagcctcctctagtactgcaaccgctttatttgctcatagatccgctggcatgaaaagtactgtatgaaccagggaaggttgtagcttcaagtttaattggacccttaatatgttctctagcagaagcatttctctcctgggatacaggatctatagccctacatagccaaaagttgcagagatgggaagcatgactctacaagtgggtcattgagtggtggtaaaaggagccagtcttacttctatcttttggtttcaagacacaagtagtctaactaaagggacgtaggactatatactggccattgattcagtgcatgcactgcattctggaagtcaacaccttgaccccacagagtactcattttaagcttatactttaactgagattgtagcaggcaatttcatctgtctcttaggctgactgcatgtgggtgattgggtacctgaattccatgtacatgtaattattggtaaacttcctttgccgtaaattatgtcttttccagtgaagcaatgctatgtgcaatatcacattgatagttaaggtatatctttgcaaagtcatgctacatggtctctcccacccaggaaagaactctggaagaagggattactttcgataaggagaaatcacagctctccaggttgtaaaagttctgatgtaacttacctgccagtaaatggccagatggtattctcaagtaatgctgtcatagagagggctcaatgtaagtttttgctgctaataggttgtacattcagtagtgacaaatagataaatcttgtagagaaggagtctgtgttactaagtgtacttatgaaatttctgtctgctctcatggctactctattcatggtttcattatagcagtcctgagataatcaagaagaaatgctggctgccattcataggaagagtcttcctatttcctggtggtttggagctctgactttgggagaaattctccaatggatattaatatgtgacgcaaagattaaaatgttttgcatcagttcccataggtccaaccacaaaggccatctcgaggtgcccatccttgttttttcaatcttattcctttgaaacccatgttcaattaatcaagccatttcccaccacccaataatttatgcatatctatagtgaaggacacttctatataaactaggtgaccaaatttacagcccacaaccatgtcacctgagagcatttccctttcctactatgttttaggaggggagctgtcatgtgtcagcagtcaacttttagctagcaccaacatatcatcaatgagccaggccagagttctcttttccctatcattttgttgtaggaaatctcttatgagtcacgtgtgtgagaagagggtaaataaagtaggcattatgaaatttacctgttcatgtaatttactcatgctttctggacctactcaggcccagatctaaatatataatttcaccaaacaatggactactgctattctcacttaaactcatgcctcagcagatctgattgtactcaacttaaagggtgattccaattacatagtcaattagtattccacagccaagcattcattttttaaaatgtaattggtatttccgtgttacacatttttaagtatcagaataatgagtcctagggttcaccaagattctttttggtgaaaattttgtattcctttctggagccatggctgtaagcatatcaacaaaacataagatacagaagtaacagaaaatatggagtttatgtagccttttaaaaataagtgtggctagttttacaagtttaggctttgtgacattgtgtgaaactactcaaatagccatctaaataaaaggatgtgttttggattaagtttgaagatttatattaagattaaccaaatttcaagaagaaataaataatctgtatattataaaaatagaatgaaaataagaattagatcattttcagataaatttacacaaatcataaattagtttaaaaattttcagaaaatttaattgtagtatgattcttaacaaaattttgctaaaatatggttttgggtaataaccactttttatagaacagagcccagagattaaacagctatactacacagaaatggcataaacaccaaaaggaaaactttaaaaaatttacttcatgagatgactatatcgggtcttaaacatggcagataatccactcatcattcttaggcatgcagcctaccacacaactttgaaaaagaaacaccgcacaaggttgaggattataaaccagagcagccaggtgcccagaaggtcagtccttaccatgaggtggatatttcttctgtccttcttagttcctcccagctacttggccctaagcagaaagcatcagctctcctgtgcccgttggtactaacctctggctatagcccagccaggcaggtgttgcagatagaagagtattgctgcaggatcgactgtcccagaatctttgtccctacttcagtggggtagtgagcaaaatgtctttcaagaagtctgtgccaacttttactcctattgacagttcctgagaacacctgtcttaactgtttcctccctgacacagcttgccttaattcaagtctaagtgtgtatgtactttggcagtgcaggagaggatctaatccccacagctttgctttttgaggaagtaacctatttggggaatacatacaccatctccctggggtggaactcatttttctgtattagctgaaaatgctgcgggaggaggatttggctgcaattggagtctctctctctctctttctctctctctctctctctgtatacatatatatatgtacctttctatggctgtgaatgtactccccacaggaaaccaggctgtagctcctccccatttagaagcaaatgtgtattaaatgcttgtagcatgctttatattgatacaatatatttttgtatatcatgaggttttataagaacctcataatgtaggtcctgttgtcccattttttatatattggggaaaattgagtaatagatgaaacaatgtggagctatgatgtcatatagtcagtatgtggtgggaagctgggattcaaactcaagcctccagggctctgactcctcatcactgcacacagtggctcagagaaccatcgcggtgaacaggaatctgcattaacagctgctattacagcaggtttttaggaatattgctagttgcctactcaagagtatgataatattctcattcaagtctcatgcagaaaataaactaaaatatgtcaagttattttgtttggggtaaaataacttttttattttatgacaattagtaaagttaggtattctgtttactttgaatgttgagtgaaatacattcttaaatatttaaggaaataaaagatgatcttaaaaggcctattatggtgagaattatttcttaatttgatgctgcctttcctagaaaaacaatgtggtttgaataaacaacattttaattcatttttaagattaggaatctttctcttgttatggcaataaaatgctctaacagaattggaatgtgaaaaattttgaatgctatgccatgtaaatagtctctaataactttgagaagagttaataaaaaattatcagcttttcagttttgattaacatatcagtgaagtcttatctttttaacttggttttaagtattctacactggtgatgtagaagatcgcaaatggcagataaatagcacttgtcccatcatctccatctggcactcatatgagacattactaatcaatcatatgctctttcccattgaaactgaatgttatgtcagaaatttttcaagacagggctttcactagccactcttagttgactggagttagtataggtgtttactgtattccatctctgacttattttccatctctgacttaaacaatccactattatctctaccatagctaaaaaggaaatatttgttggttacttactatgttttatattctgtgctaaacaatggaaatagaataatttaaaaattaagatagtttttaaattcgtggtaggctgtcataagaaacaatcccttaactcaatgacttcaccaaataagtttgtcacttatgcaaagtgcattgcagatatcactggttgggtgactccatgaggcaactgtcctccaaggagagatccaagaactctggttccttctaacagtggtttttccattttcaaggtagctgggaaaaaccatagcacatttaaccacaatgtcggcctggaagtgacacaaatcacttttgtttatatccactggccagaaaaagtcacaccacctcaactaaatgcaaagaaactaggaaatgtagccactgactggacttccttttcctaaatgaaactgtggaaggaaggatagcctgaatattttaataggcaactagtcatctctgaaagaaatagtcatagtcccttactcatcagatttaccacctaataaactctttatttccaaaccgtgctgtttctcaagttcttcatctccagcagcatgtgccctataaaatctgtggtcatctctatgtatatataacattcatattatatatatatatattatttatacatatattcatctattcacaccaacatatacatacacacacactgcctaaatttgaaactgtccatcattctcaaattaacacaaatttatgaacttctcttttctgttattggcattcttatttttttacagctttactaatatagagctatttttggcttcttcgcaagcttttaaccaggtctatccaatctttaaataaaaattaagattatttttcagctgtgatttttaaatactttttctcaattctcctgaatctacttcaatctgaaattatcatggccccttctctaaaggggatttctcatttccaactaataccttttttattactggcacatttagctccccatgactaattctaacatatcttatactaaaaacattctttatttatttaatgaatgccaacattttatcttgtaaagacatgcagcagcatgatgcatttcatgtatttttacttagctgaacactggctttgtgggagtagttctccagctgtttgtggtctgtttttttgtatgaacacatcactctttatttcctctgtgtgaattttgaaggctgaagcaaaagattcttcacccaaaaatcacattctttatcaacacctcccaggctcttcacaattaatgctggaataactggatatccacatacagaagaatgaaatcggaccattatcttacaccatatacaaaaatgaactcaatttgaatgaaagacttgaagataagacctgaaactgtaaaaccactagaagaaaatttagaggaaagctccataacattagtctaggcaaaaatttcttggatatgacaccaaaatcacaggcaagaaaagcaaatatagacaaatgggactacattaaacaaaagaaaacatttaacagagtaaaaaggaaacctacacaatggaggaaaatatatgtaaaccatacatctaaaaatcagttaatataaaaaatctacaaggaactcatacaactcaatagcaaaaaaaacaaataacccacttaaaaagtgtgtgaagggcttgaatagacatttttccaaagaagacttacaaatggctgtcagggacacgaaaaaatgctcaacatcagtaatcatcagggaaatgcaaaccaaaattaaaacaaaaaatattatctcacacctgttcagatggctgttatcaaaaatcccaaaaacataacaagtatttaaaagacaatttagaactcttgtacactattgatgggagtataaagtaatgtagccactagtaaaacagtatgcagtgtccttagaaaattaaatatagaaatatggtatgatccagcaataccacttctgtgtacttatccaaaagaactgaaattggaatcttgaagacatatttgcactctattagttgcatttacaatagtcaaaatatggaaacaatctaaatgtccactgacagatgaatagatacagaaactatgatgtgtacatacaatgaattattattcaaccttaaaaaagaagcaaatcctgccatatctgacaacatggatcaaccttgaggacattatgttaagggaaataagccagatacagaaggacaaatactccatgattccacttatatgaggttatatcaaagtcataaaaacagagagtagaataatgatttccagggtctgaatgggaggagaaatggggagttgctattcaacaggtataaagtttcagttaggcaagattaacttttagagatctattgttcaacattgtgtctatagttaacaatatgcaccatacacttaaaaatttgttgagggtatgtctcatattatgtactcttatcacaattttaaaacaaggaaaagcctcccagggagggaaaattattcaatactttcattgtctaatatgataaatgtgagccacatgcattggagtaaacaagatacattattaaaattaattttatgtctttttcaatgtacctgctacaaaactcaaagttacatgatatttacattatatatctgttgcacaacaccacactggaggagatcttttgcaagtatgaataaatacacttaatcttatagactttgggttaaataagggtcttgtggaattaaatttgctgttatttgacttgtagtcagctaaaggaatgtattctattttctctatttttagttgtagttcctgatgggtttaataatgaaaacaaacttgtatatatgctgagagagtagttaatttggctagaaaaattattttttaaagaatgataaattgatgcagtggttatcttagaatgaatgctttcttcaaaatacaagcgttgacattcaatgtgacctttagtgtcttgcatgctttgtttagtagcttgttttgctctagtatcctctgcacgttccatgtctgtcttacttgtatgatgttatcttaaaatctgttatcctttacagttaaataaactatggagtccaatattttaattttatcagatgttaggatatttcttcagaatagaacatacatttaacatcctgtctactttaatggatttgattgattgaatggttgtattcaaaagtttttcacactcttcaaaaatttatttatattataatgagcaattatcaagtgcattttggtgagactggaaatgtcaagtcaatagcggttcaagtctttgggagtctatattaaaaatcttggcattgagaaaggataatgagaacagggaaatctaccattggtgacaacagtgacttaattaccttagttttcaatttcataaggataagaggaatgcatgaaaaatttgacaatgggtattttaaagaagtctttctttcctgatgtgagccttaccagaaaatcactccactaatcattaaagtaaggtgtaattttttaaaagctagttacttcagaatatgaatatagaataagaatctgcttcttcaaaggccaaacagcatcatcttaaactactggagtatttatgaaaactcaatagtggcttgtaactatttctatggtggtggacacatttaactttaaagtagccatttgcctgtggggatgttaccctttgaaaacattttccttgcagtgcagaatttctgattagccatttaaccttggaagaccatgtatctgcagtgctttcccaaacttgctccattttcctcttgattccttgtgtataattgggtggagcctatttcattaattaagagttttagtaaaaaaaaggctgaagtgaatatatagtggagacattgcataggagcaatgctgaagtttctgactttagttttccttttttttcccccagttcgtttgttgagttgttttattctttattagatttatccatgtcaagttgttatctcagaagcgcctggctagcaggaagaaattatgtgctacccacatcagctagcttggccactatgtggataaggtggaaacatgggtaatatcacactggatccttggtaagcacctgtagatcacaggacactcccatgctggggactgttgtataaggtgatacccatagagcagcaccttcatgtttgagctagtggcagtgttactgtcaatcaaagcctgtcagagggagctcaagatggccaatgggcccatttctcaatccagagaaagctacaaatacaggcttttgatattgtctgtaaaagagattactttcttgtcaaaattactaacaggttaactgtaaatttaaatatatcacaatttttggaaacctgttttattatggcattgaaacaaaatattacaagagactcaaaaactggaagtattctggacttctccatgtgtttatgaggccttgctattcaccagtgaaagagtagctgagatcctctgctgagcaaaagcttctgaggctatgatgtggactcagatcctgggtcccctactgtctgactgtggtcatctgtcaggttcagtttcctcacatgaagtgtagttaattacactttaaaaaatgttctgaaagaaaattgagataatgtgtattagcttactgggaagtattaggtacaaaataaccataagctaataatatcactaacagacatgatttattagtaaatcttctactcatagagcatgtctctgtgtacaaagcttgctaccttaggttcttcctacaagtgtcatgttttctgtggcattttcaagaataaattatatttttataattcttaaatttgtttttaatttttatgcatacatagaagttgtacacattatagggtacatgtgttatttttctataagcataccatgtgtaatgatcaaatctgggtaattgtaatatttcataacctgaaacaattatcatgtctttgtactggaaacattacatattttctcttctagctatgttaaaatatacaataaattatgttaaccatagtttccctattgtgctactgaacattagattttatttcttctatctaactgtatttttgaacccattaaccaacctgttttcaccccccacttgccattacccttcccagcctctgtcaaccaccattctattaactatctccaggagattattttttttagcttctacgtgtgcatgagaaaatgcaatatttgtctttctgtggctggcttatttcattaaaataacgtcctacagtttcatccatgttgctgcaaattataggatttcaatcttttttacagctgaatgatattccattgtgtatatatgccatgttttctttattcattcatccattgaagggcacataagttgattccatatcttgactattgtgaatggttcttcaataaacatgagagtgcaggtgtctcttcaatatattgatttcctttcttttgaatacgtacccagaagtgagattgctagctcatatggtagttctacttttagttttttgaaaaacctccatatgagttttcacagtgactgactgcagtaatttgtataatctccaacagtgttcaagtgttcccctttctcagcatcttcaccagcatttatcatctttttgactttttgataatagtcattctaactcgggtgagataatatctcattttggttttgatttgcagtcccctggtgactagtgatgttgagcattttttcatataccaggttgtcatttacatgtcttcttttgagaaatgtccatttagcacttttgctcattttaaaatcatgttatttgtttatttgttattgagttgtttggttattaataccctttcagatatttttgcaaatatcttcacctcttctgtgggttttctcttcacttattaattgtttcctttgctgtagagaagctttttagcttgatgaaatcttgtttgtcaacttttactttggttgcctgtgcttttgaggtcttacagaaaaaaatatttgcccaaatcaatgatctggagcatttgttcaatgttttcttctagtagtttcatagtttccattcttagatttgagtctttaatccatgttgatttgatttttgtaatatggtgagacataggggtctagcttcattcttctgcatatggatatccagttcttccagcttatttattgaagagactgccttttccccattgtatgttcttggttacttggtggaaaattagctggctgtaaatgtctaattgctctggctaggacatccagtactatgttgaataaaagtagtgaaagtgggcatacttgtctcgttccattcacagtgacgcttgctataggtttgtcatatatggcctttattgttttgaggtatatttcttctacacccactttgttgagagtttttatcatgaagtgtgttgaattttatcaaatgctctttctagaatttattgaatgttcatatggtttttgtacttgattctattaatgtgatttattacagttcttatttctgtatattgaaccatccttggatccctgagatgaatcccacctgatcaagaagaatgatctttttaataggttattgacttcagtttgctgaggatttttgcatgaatgttcatcactgatattggcctatagttttatttgtctagttttgatattaaggtaatggtggtcttgtagaattagtttggaagttttcctccatccctattgttttggcatagtttgagtagaattagtattattcgaggatctactttctgccacttttgtctaatagtgcaccaccgtggagctggaagcattaatgtttcacatcagcacagttactacatctaggatactccagtctttgtgcactgaagctgcactagcaactgcaaccaattttttaattatttttttattgtgataaatatatacgtaacatagaatttactattataatcattttaagtgtattgtttagtggtattaaattcatttataatgttgtgcagccaccatcaccaccatccgtctccataactctttctatcttgtaaaactgaaacagtatacccattgaacattaactttccattctcccaacctttatcccctggaaacaactttcactttctctgtgattttcattatgatttttactactgtaagtacctcatataagtgaatcatacagtatttgcctctttgtgacttgcttatttcacataacatgatgttctcaaagctcatccatgctgtagcatgtatcagaatttcttcccccttttaaggctgaataatatcccattttataggtacattgcattttgcttatacattcatctattgatggacacttgggttgctttcatattgtagttattgtgaataatactgctgtgatattattcatagcaatattatttatatatactctctgagatacatacatatatattgtggtgtgtgtgtgtgtgtgtgtgtgtgtgtgtgtgtgtgtgtggatgggtgtgtatttgagaccctgctttcaatattttggatatgtatccagaagtggaattgctggattttatgatactatcatttttaatgttttgatgaaccgcaatactgttttccacagtggctataccatttgcattctcaccagtagtgcataagggttctaatttattcacattctcatgccttcatttttcacacattcttaaaggaagtcaaaataagaactttgcatttaagggtagacatttttctgaagtgagggggtagatgttaaaatttactttaattgggaatatgagaacagggctataaatgggttatgaaaatcaacccagatgattaaaatacaatgcagtaatgtgagtaagttctactctttgtggtatgagtagtatgtatgaagatggtggtctccacataaagggagctgtttttaaaaacaggcagcttggaaagcatcataaaaatggaaattcacatagatgttcaatcattagtaagcttcttttagaccctgaaaaagcaggaaagtattataggcatagggtccaaaataagtacagatgggatgaatctagtttaccaagaaatggcaaagcatttggacttaggagaaagtttgttagaaagagagggagagaaagcacttatagcattttacaaatatgtttacagttttgtattttatattaatattacttggaaaccatttttccttttattaggtaaatgatttttgtcacatccaaagatagtctgaatcaaagatttatatcttgttggatttcttttattctagtcattagtcaggctgcattcttttaaagtagatgttctaaaattataaaaactaaattctctaaatgtatttaacaaagaactctcatttaacaaagatcctaacaaagacccaagatgaacatcatgattctttcacttatatttctacttttttggttaaatatagcttgtttttacaataaacatatatagcaatttttttctgttagccattttttcttatttgcccaaagttctggctgaacccatttgtgctaatttgactaaggtatatgaccgatagtaaaccaatattatatttgaaatcataaatgtggaaatgggaatgatgtggaaattcatgtaaaagctttttttgatgaatagaattaaactttaacaaaatgaaccaaataacatctttgtgtttgttcttgcccaaggcttgtatctcaaaagcgttattgctgtagcaattgattttcttgtattttaaaatagcaaaggatttttaaaaatgtttttaggtaacctgaaaaaaagaaggtgatttattttctgctaagtcttgttaccagtcggtagtaacaagaactgtaaaagttccttagagaatgcttaattatcttttgagatgctctcaggagaactgaagagaagcttataaaaaggaaaaaaaaaaaaaaaagctttttctaagaactgttttcacccaattaaactataactgatttgtggttagcccatgtcataagcctttaggttttgtaggaaataagggagaatcattcttagcaaaagaaataaaatacacaataggaaattaatggagaaccaaacagttgactatgtggatttatcctcaaaatgtttctaatttgatcattcctttttataatctctcaatttgcttctccttaaaaaatagaaaaatcactcaaaataatctataaaaatgcacaaaaaggtctctgatgttatgaaaatactaaaggaaaatagaatcattatgatgattcttcacaagtctgaaatcatcagagactaaagaatccctgcagaagtgattttatttaatttcccagctgaatactgcctttccagtggagaagatcttctcctaagaactcttttataatttggaggaacttcaagaaatgaggatgcatctctttcagccaaaattatttgtttacaacttgagaataattttaatgaattacttctgcattagcagagaggattgtagaatggtttaggtttgtgactcagaaaaccctctgtgatattgatgtgacttaagggtttatgcatcaaattaatctgtgacaaaaactgtacaatagcatgatatttgatgtctgtcataatattgcacattatttcatgttgtctttgatctttcctgagcctgtatcagggaaatcactatctaaagtgtaatgtgctatggaagagatgcatcccagtctaaaccccttagcctggatcatggaaattaaattttgaatgtagatttcatatttgcttcaaacatttacctatttctcaacctgaacatgaagtaatgagtctaagaacaggagactgttttttcccttggtattggacacttcattgagaagatcactatgcatttcacactaccttattcctactgatcccaaagcagggctttcgtatttgatcagtgctcagtagtattcactacaccaaagccctatgtccctaccagccatttggtatgtctgaaccaaggaagtgaatctgtgtcattccaaggcacatgagagccacacttgaagtagtttgttgtcctcttaaccccaaaagggataatctttaattaattactttgccaaagcattttatgtttgtaaatgtttaataaatgtcctggcacttttaaaaatgatttaaatatttttgccactttttgattcaaataaaactgtaataatttcagttcaatgcaactgaaaatatagtgtcattaaaggatatttactgctaaattccaaatctcaggtttgcgagccatctctgggcagaagcatcaattcttactaagtttattacctcaagttattatcaatcttgtggtggtaggtggggaacaaaaatgatcagctcacagaatttggttaagaaaggaaaaaaacgaaaacaatgcaaatgacaggtagttacagatattagtaaaataaaaatacaatctcaagtatcagtttcttaaattaatagaaaaaaatacaagcaaagttacaacaattattattatgccagatatgggatctgggtaagttatttgcattttatagtgatttcttaagcctcatgtccactgagacggttttacaaagctctattagaaatagaaatttagatatctattacactttatcagacggtgggatttttccctaagcaagttctgtgtccagattattataggttgatgcaagagtaattgaggtttttgccgttgcttttaacagcaaaaaccgcaattaatttgcaccaacctaataatttaaattttatttgacattaaatttagttatttaaattaattggattaagaggagttggaaacttccctggcataaatatctatagctacccctttctgtggtttttagaactaagtccatagctaaggaatctgaaagtcaggcaagggcatgtaatagataccttaacatcttgtcagccttttgttcctttgattttcagccttcagtccatccatccaccatatctttattaagcattcactaagagcagcagtcagctgagtcctgggcacacagatatgagcatggcagataaaccgtttgtcctcatggagcttgtagtctgtgtgagcctgatgctgagcatgccaaagagaaaacgacaagatccagggaaggaaggcacataaaacaaataattacagcctgagagaagtagtctgatggagacttgtattgacattgcagaggaagagcaccactcttcttaagactgtccatgaagttgtccttcgggaggtagcatttgagctgagtcacaaagttgagcagcatttagacactgctgccatcactaagtgatgcaagtctcaacctcatttctccttcattcaacagttatgaggagcttagagtaatcagggaacaattcctggatgcagtggcattgcaggaggcagaaatatgattgcaaggcttttcagccctgagaaggtcctgcgaggcaggaggatcgttttctttgaactcaggaggactggattccggatgttatcagaccagcgtttatcttaagataaatcagggtgtaaggaacccaataatgtatgattttagggaaattttaggaaaagactgctttttctcttccaagtatctgtcccttcctctgacacagggaattaaacaaattacatcatgatcaaggcattccttctaataaagtcttcaaactttacctaaaggagatgccactgtattaatgctaggattttcccaaatgtcttttgaaaggcacacatcctgcatatgtttgtgatttgaaaaaaatggtttcataataattaaatctgggaaacactgcaatctatagacctctcctgaaaattaactatgcacttgtaaattaaggagcataggagtcctgtggttaaaaaataagttaactgacctttgaacacctctcccccttgagtttttgcagaacatctattatgctgaaagagctttgaggcacatcaatcatttttaaacagcaagataagctccctttcctgagctggagaacactgagctctaactggtggatggagggatggaagatcagacagggagaaacagaggaggacaggagaagagggtggaaataaggaggagattttggataagtggacaattttctggtcagcgctgacacctctagctgagagatgacacttcatgtcctaaaatgcttccccctgttttgctgtcatttgtggccacattcagctactgaaagtgtgaggactttaaagggtctcagggctagacgttctgatggttcaaggcacttcctcctgggggcctaataaccagtttctgactcatagcagcatcagattctgacacctgaaggttatggacacaataaaatctctccagcatgagcttccgtgtactcttaccaaaaaccacacgctgacagaattagtatgtggagccagggggactgaattgctgggcaatgggtcatactaaaaataaaaagatgtaatctacttaagtagatatacgaagccaagaaataatttcaacccttttcaaaattcaatcctttgccatatctttacaaacaaacgaaggggagttgttgctaaaaaatcactatgctaatttttagtcacattcatgcctgtgagcacgtataaggagttccaagataaattttaccttctttagccttgttaaaatgcttagaaattaatatgcattgttatccaagattatgaagtgatatatgttctttggaaatataaaaaattaagatataaaatacaaaagttattataaataacattttgatgtacattattttagtttgttccccaagatgtacatctaagtattcataagttttttaaacctcatgtctacttcagtatacctattttgtagacaaaatctgttttgtagattttcttcattcaaaaatgtaaagacaacatttctttagccattaaatattctacacagtatgcctttatatgagtatacaatgctttaacacaattaattgtactctatttcattcccaatgttttcatattctgacttttaaatctttttgtttgcctttgatatttttactcaaagtaaatccctaaaggcaaattgccgtgtcacagtatgtgaacatttttaaaactataacaagttgtcagactgctctcaaatattatatatcttacaggtctctcaggggctaggtggaagaggcagtatttctctattctcactaataaatgaggattttaaagtgccaacaatagttctttaaataagtcttcttccacttgtattttaccgcaaatgttactgactgttttctaattaaggtaaccaggtgaagcctttcttggtcctgtgtgtggctgaaatcagggctgaaaattatacatgaagctattttttaagaaaactctaaactctacagacatcttttatttatttaatagtgcttaacattgcaactttgaatgagacagagtaaagctgtcacattttttcttgtcagtttaagtggttataaaacagctgtgatcaccagcttaatgaatgtagaaattttacattaactgtggatagatatccatcttcctcttctttttattagttattaagtacataataaagtaatatgtaaacacatagaaattagagaccatcttctttttcagaaagcctagttttgctcacttaattaggagttgttatttgatgacaattttttaaaaaataatgatgttataaatgtcaaatagctttttatgcattacggaatcagacattcactttgttgtggagtcaatgtgatgtcctaggttaaggaagaagtgcatttttcatgtttctcaaaagtactggacttcgcacaagtaaaagtaagaaattaaaatccatacaaagtgaaaaactgtaactgtaatgtgcgggacacaccaaaaagagggtggcatattaaaatgaaataaaaaatcattcatatttaagtctaaagaaaatgggccaaagtcaatgaaagattgtttagattcttcagcacattgttttcctaatcacattgtttaattacctgaggttaaaatatagacgaatgtattagcaaggagagatgcaatgattaaagactggtactattagttgtgagattttcaaggacatccttatgaacagaggtagaatagattttttttgacacagagaggctaaaagtatatgaaaagtcctgagaccattagtgatctataatatctcaaagaataaccactgaaacaagaaaataggtacaactagcttatctgaatctaccttaaggaatcatcataaaatatctcccaaatagaaacgtaaggctttatcacaaatagttaacataaacgttaacacggatagttaaatgaagtaaaattaagtttttccaaataaatttctcaggtttacagacagcacagtatttagatgtcttatttacacaatgcctccattttagctacagatgtggacatcctcaaaggttgactgaagactggtcagtgctattctgtcatttccaggaatgacttatagatgctgaggcataagtcctcctgtcttgccatgcaaggaaagggctatgaaattttaagttatgggtgctacggagagcaataaaaacaacattttagaattattcaggtaatgcttaggacctgtgaacttagaaatatatgatggcaaaaataattaccacggtgagcatttacaaatgaaaaaaaatcactttaatacccaaatagaggaattgggtaaatatatgatgatccttcttcccaatggaatcaacacagttaattagattgaaatttaaagagaatttgtgatagcttgggaaactgctattaaaggagcagtcaacgatggaaaaattaaaaataattttaaaattttcttatttctaaaacagctgaaagaaaatatagcagaggtttaacgttatttgatttgctgttcatgaaccctgtgtgttattcttactttcccacatttatgattttgcaaattttctctcataaacctatattaattatttccataatacaacccacccttattttaaactgtactgtgggtcccatgagcaatgcgcagagcggggcagctgtgcagcttccaagagaaggggctgcgcctggctccacactcctcttctgggctgctttgctatcccagctgccctctcgtcccttcctatcagcctcttgtctgtgctgctttctgcaagttttacatttttctttgtaaatttttcacaggtaaaggacctatctttatctgaaggagagaataaaatcaatctttgctttctctttgtttatattttgtgtgagaaatttgtatgctaaaatcaaatgccaccggtattcacaaatagggtgacatttgtgttgtgcctgattacactgtgagccccactcaccctctctgtggctcctgggggcacttgtgagtgcatctgtcacctggaatcacctcaggttccctaccgtgttacctctctcctgctctggctcccactcgtaagggacatcagtagggccggtgtcatgaatagccactatttttttttctttgagaaggaggctcactctgtcatccaggctggagtgcagtggcaaaatctcagttcactgcaacctacacctcttgggttcaagagattctcctgcctcagcctctcaagtagctgggactacaggtgtgtgccaccatgcccagccaatttttgtactttttggtggagatggggtttcaccatgttacccaggctggtcttgaactcctgatctcaagtgatctgcctgtcttggcctcccagagtgttgggattacaggtgcgagccactgagcctggccaggaacagccactattaaaatgccaatgttcattctcaagagctcagatatcctcacaggggctgattgatggccaggtgcaggagcaatgctggtgttgggaaactggaagaggccactgtggctagaccatagaaagtaagtagagcatgacacaactttagactggagagtcaggtggggcaaattaggcaagacctcctaggccaagctaaagatgttaggctttatccaaggatcaccagatagctcttgaaatattttaagcaggaaagagcgatatgatctgatgtgaaaagtaaatgatgatgctggatatggtccacattggcacaactggtgagagatgaacaagggtatgagcctgagtcctctggattaggaaataaggaatctgtccacaactacagggaagactctggtaagtgcaacttacagtttacaaattttaagagaggtgccacatttgaagagactgttaggacaattactatgcagctccagtttctctgctagcataattttgatcccagccaacccatgcttttctgtcttaaaaagaccaaatttagcaggtgtttgagcctggaagcaagaaagcaagttaaaaataccaacatcattttggctaaggaatagatttcctttaagtgtctctgcacttaagcattcatcctgagtaaaaaaatgtatccagcacacagattgttccctctcatgttactttctatgtcagacttagcaatctcaacactccatccaatctaattcagaatcattaacatttgtacttagccacatggattcaaatgctgaatgtttggaacatttacagacagatgttatcaaagatgttctcttttcacagtttcctctgttaatttgcatagaacaaccattgccactgaacatgaggtgcagtcaacagagaagcaatttttttgttgttgtttgcttgctgttgggttctgggcatgtgcttgtattgggaaagtgttgtactttactgcatttaaataagtattacttcaattatggtttgttgttgctgtgtttatagatttactttaatcggttaggaagcagatattaatatgaggagaatgtgttttcctgtagatgctgattttaatagaaagacattcaggacccactttttcattgaattctgcctttctttttagccaaaattgggtcctttgcttttactaaaaggtgcgttttatttactcctttttgcaattccaaggttgggtagttttgaattaggaaaacatcattacctctaacattgatttgtcagagtcttcttatttacctttcatactgaacactaaaaggacctagaaaataaataacaaagtccaacccaaactaaaggtgcccttcatgtgtgaattttatgacttctctgctcttgttcataaattattaccaatcaaaggattcttgtccaagcttcactggggatgaaaagctggtcaagattcagacaaaatttgctgctgaaatgagagcatttttgttagtagatatggaaagaatcaatttaaccaatatattagcacgtatgtcacttttcctcagtcttagaaaataaaagttccctcctcttgtcataggtcatcatgtctaactctgctcttcatcagatctttcccatttccttcattgccattatatgtccttcatcttgaaacactggctagtgtccctgcgacctgtgtacatgttgattctcaagtttttgttaccaaaaaacccaaatctcttgctcttcattaactctctaacgaccatactcactcccctccttccttctttttcttcttcttctttatttttttttttcttcaagagagagctaacgactgtgaaatacagatgtcaatgaaagaccttggcatgcagtgttccagaaagattaatgtagccatgggctgccagaggcaagtagatctgttttctggctattgcaagagtttattcagtgcagggtgatgaatgtctgctcaaagctgctgttccgaatatcctaatttgtttcgactgccatggttttttcaaattttatcctcaaaatcatcctcaatgcggaacctgtcttgtgctgccatgttacccgcctccattttgaaggcttcatctggtgctacttaatcaacattcaccttggttttttgttttatttgtttgctatcctatttctactttgttttacctcttgcttttcatgacatctatagttttgaatataaatattctccaggaatattaggtcttattgattcaaagggctaagctttttattatttttaaagaagtaggagataatattactgattttaagagataatatgctatttttactactatatagctgtgggattttgttttattttattttgtttttcggtatgccttcatatctgataagatcagctgtttttcctaagtcttcattatagatgtctttgaaaagaattaacatctttacaatgttgaattgtctatcagggaaaagagtgtaactttatttcttcaagtttttatatctgtaagtggaattactaaagcttgaaaatctaaaatattctctataatgtcttgtgcattgtttacacaactattattgtaattcctaaatattttatcttgtgagttttaatattatcttatttttaattttattttttacttgattatgcctggtataggtaaatttttgaaaattaatctcatatcaaacaacttcccagaactaccttataatttttaagaatgtgcctgttaactacattagatttgctttgtagatgaacatatattggtaattaataatttttatctattcctattattttattttcttattacattttctaggatctttagtacaatatagaaaaaaatcaaatctaattaaaaacattgataagaaacatctttatctcatcccctcctttaaaaaatatgtaccaaatcaccccattgtgttgtgtggggttttgataaattctccttatcaagttaagggatttctctgtacttttaagtttcccagactttgattatcagactgaatttcatccccctttttttgcatttgggaaaatcatatacatttgtctattattttgttaatttgatgacttgtattgatagatgttctgatattaaatcattatattctctattgaacatgatatatttttgtaaattgttgagatataaaagctaatttaattaatctggatttttttcacacctgagaaatgcctatacaattttctgtttttagttatccagtttagcttatctgttccttgaaagcttgctagaattctttgtaaaactatcagagccttgtactattttggtggaaaggaatatatttaatttatatttcaatttttaatagtcattgtctattcattaggctaatattactagttttggcattttatatttttctagaaatgtattctgttttagatttctaaatttattggcatatggatgcacaaaacagtagtttattattatagcattaatacctggagatatttccctttcaaattctataatatatttatttggtctattgccctcccatagacactgaaaaataagtattaacagaggttatctaacttttagtattttcaaataatcaatttttggtttcctcatctttttgactggttaatgtttcttttttatttcactgattgctgcctttaatttttttattttctttttatttttggctttattatagtattttttatgttttttataatatctaacttgttttcacttcctcttgtggtctgatagatccattgaaagctgtaatttttccataaatttcttgattgagctatgccctcaattgttgatatataggtttttaattgtcacttagctctaaattgttccttattcccccataccattaccattttgacccaagttcatctggtcataagtgttttaggatacaaatatgtccatttttaactattttcttcattgatctaattatttttcacttgatcagtgaaaaatatatcatacataatatgtatgatattgatgttttgaagtttattgaggcttcctttgagagttcattcagcattgacttttgtgtatattccatgtgtacttaacatgtcttttctccttgtctgatataaaattaggcatatatctattaagtttatgagccatcttattcaaaagttctagaatttttcttattcttttttctttatcagtttctaagttttctcttttaaaatcccaatcacaattgttcatgaacaattgtttatgaatctatttttcctatagatgtgatgatttctgcttttttgtatttcaagtatagatagactcataatatgattattatggacttttcacttattatctttcgtagtattatatattgtccttcattgctgctttcaatttacttgttgtcctactttgtattttaactgatattttatttattttattttattttttgagacaaagtctcactctgtcacccaggctggagtacagtggcacaatctcggctcactgcaacgtccaccttccggattcaagagattctcctgcctcagcctcccgagtagctgggactagaggtgcgagccaccatgccaggctaattttatatttttagttcagaaagggtttcaccatcttggccaggctagtcttgaactcctggcctcaagcgatccacctgcctcagcctcccaaagtgctgggatttattggggtgcgtgagtcaccatgcccagccttgactggtattttaactgccaccacaattgtcaattagttattattattttcttattttataatttttctcttctctttctttttgattttttctgcatctttttgccactaatatgtatatctcataggtaatattttagaacaatttctaaaaattcattcttacagaaataattttttgttgtaaactatgctccaagcagtcttgtaagcactttgcctgtatcatctcatttcatttatataaagctctaacaggcattactgttagcgttactttatatataaaaaacagccagtggaattttaaatagcttgcctaaagataaacagttaatggttccaatacttgaacctgagcctatactctttaccactatgacgtgctgccttctaataaatttataatgcctttttattgatatgtaatacatgtacatatttttgggatacaagtgataatttcataatttatataatatataatatgtgaaggacaaatcagggtaattgagatatccatcaccttaaaattttatcttttctttatgctagtaaccttcaaatcattatcttctagctactttgaaatgtacaattgattaatattagctatagtcaccatactgatctattgaacactagaccttatttcttcttcctaactgtgtatttgtacccactaatcaacatctctttatccctcctccccacctcttgtaacaaccaatctactctctatctccatgaaatccacttttttagcttccacctgtgactgagaacatgcagtattcatctgtgtttctcttaataaagtcactcccagctctatccatgttgctaaaaatgataggatttcattattttgtatgtcttagtaatattccattaggtatatatacaccacattttctttatccattaatggacaattaccttgattccatattttggctattgtaaatagtgccaatcatgggagtgcaggtatctcttcaatatatttatttcctttctctcaaatatacacccaataacaaaattgctgaatcatgtgatagttctattttcagtttatgaaaaacctccatacacttttccttagtggctgtactaatttatataacccccacaatgtactagtgttctgccttctccacattcttaccagcatccattattccctgtcttttctgataaaacccattttaaccgtggtgagatgatatctcattggagtttggatttgcattttccttttcttctttttttttgacagagtctcgctctgtcaccaggctggagtgcagtggcactatcttggctcactgcaacctctgtctcctaggttcaagtgatcctcctgcctcagcctcccaagtagctaggactacaggcatgcaccaccatgcccaggtaatttttgtatttttaatagagacggggtttcaccatgttggccaggatggtctcaatctcttgaccttgtgatccgcgcacctcagcctcccaaagtgctgggattacaggcatgagccaccacgcccaaccttgacttgcatttttctgatggtgaatgattttgagtcttttccatatacctgttggccatctacgtgtcttttttttttttggttgagaaatatctattcagatcttttgcccattttaacatcaattttcttggttttttgctgttcagttgtttgagctccttatattatacccatttttcttataaggaaattgagcctcaggttaaataaaattgcccacacaataaatgctggggctggactttgaacctaatcaatttggttcttgagtgtacactcccaactattttctgtttacttcttatattatacagttatacagaagtgagaaggtgaaatacaagttggggaggcaccaagacatcaaaggaatgaagcacaagatgcaagttcagaatatagtagtagagatggtgagagtttcattctgtattggtcctctctgtcctcactccttgttctcctctccttaggcattctggttttctatatggttttctcttaccccatcaaaaatctaccttcaaaataggagcagcaaaatccattcatattgaagtctggggactgggagttagttatttcttctgggtctaatggtaagagaacacattagaggaaaattttagattccagagtatttcaggcatatagagattatgtttgttaagcacgaaactcatagattacaaaataatacatttaaagaggtgagtaaagaaaatgccatggtagcagtttagagtggcaagaaatgatggtgttatgaagtcatagcaattgtaacttgttatagacactaacgattaaatatcctgaaacatcttctgttctaacttgagtgaaaatgcccatttattcacttgccaattttaggattcaacctgaagccaaataagaaactaagaaatcccttttaatagttgataagtcagctaattgaagtttatgtggagtggttgtagagtcttcctcaataataacacaaagaagagatcttagcatatgatcagacacgattataacactgaaggaagagttagtgttgttaaaattccatatgatatatagcattaatatcttgacatatggctggttttttttagttttcaacaaaaatagcaataaataatttaaatatatgtcaaaattaattattaagccttgtgtaatgagcgccatttttaaaacacacatttttattgtggcaaaatatgcataacctacaatttacaattttaaccatttttaagtgtacactccattggcactaaatacattcacattattgttccatcattgtctctaacctccagaactttttcatcattccaaactgaaactctatgtccattaaacaataactccatattcccccagaaccctaccaaccttggtaaacatcattctactttctatctgtatggatttgactacgtcaggtacctcatataggtggaatcctacaatatttgtcctcttgtgcctggcatattttattcagcgtgatatcttcaaggttgtagaatgtgtcagaatttccttcattttcagggttaagtcatattccgctgtatgtatatgtatcacttttggtaatccattcacatgttgatggacatctaagttgtttccactttttggctattgtgactaatgctgttaaaaacattggtgtgcaaagctttcatgtatatctatatatgatttgagtacctaaaacaaaatcttttagataagacaaactaataagacattagaaatctaatacttggtgttaactgggatgccatacctggtgaaatttttgaatcatttgtaagtatccgttatagagtgaccacacaatttatcatccaaaccaggatagtcttgacaataaaaataatatgactaatatttacctagacaaaatcggcacaaaacagaactatcccaggcaaaccaggtcatgtggccaccttatccctttgaaaggcagtttaataaatagaatcttttgtttccaggtactggaatctgtcatttgaaaatattgtatttaatttcactggaaattgtggtcaaattttcagattaggaagtgtattagtagttttaaacctctgggattccatttagtgagatgaagtcaaacccgtctatttcccttaagttaaccatttaatactgtcctttgatattatttaaagaaatgataattattaacagaggtggcaccaagcgataggtctaggtgaacccattgttttctattgctagcacttttgtcagtaattatctcagattctccatgagaagagaataattggacacaataaaaatgaattttgtactttgggttcttttctttctctgacataggtccaaccaaccaatgcatatagttaatcacttctaaagggaattaattttgtctggatctcaagacttttcccttcattcatcagaagcagaaattcagacattctggcatcccattgatcctggtagcaaattagatccccccttccttggatatccaaagtctagggggacactgattatatctatgtaattagtacttcaaggccaaatggaaatagaagaaagaaccaagccccaacaattttattcctttgataaattatcaaggtaggtgggaaactgtttagataagtgggatgtttgaaatctaaaacctttatctgagtacttgattaacactttgtttgttgggggaatagagagtattaggtgtaactgcgccaaaggaaaggaaatcaccttgataaatcaacataagggagaaagctaggttggatttaagtagccattcagttaataattaggtataatttataatgaacaaattgattgttttatatattatagttcactctctttgctctgacatatgccacatttatgtctcagatgagtttttttgaaaaaatagatccctttgttatagaaccccataaagaagcaaattagtgtttccgcagaggaacatatcagaattctcacaaggaggacagagactacaaagagcttcttttcaggttaggccagattttgcagacaaataagggagtaccaatattacggaaaacttttagttttcagtaattttagatttcagatatgtagatgagagattgaaggcctatgatggtatttatttttagatttataaagataatatataaaaataatagtaacatattgtagagcttctagaaaatccaaaaaaaaaaaaagataaaaagaaaaatcacctgcctttcagagaatgctttctagctgtttggatctctcttttttaacataattgagattgtacaatacatgcagtctcacagtttgctttattctgttaacatcagatattctaaagggtatttttgaaacaaactcattagaaaaactgacagaaagacagcagacctagaagaggcagctctgctagtcaataatggaagatgtggaagactattgctacaagaatttctgagctttttgtaaagagtcattgagcttaagtctagatcaaattttaaagttataaagcatatgatgttgtatggattttttaagtgcagaaaattcttaagcaccattttaatcaggcttcccagcttttttccttctttggtggtattgctaatgagaacacagttcttaatttgaggttatattgtcttatccaatgtctattgaaggaaaaaatgttattttaggatttccaagctatgttgtttgcctttctctttttgtaggtcttatacttgctaactcaaagatttactatgagaaaaagtgtgtaatgtgatctctgaaagaaacactaagtgtttaaaatgcaccagaaatctcaaaatcccttttttaatgtagtattagacagcttcattgaagtgaaaaataactggcctttagaagcagtgttttaaaaattatggtttccagtattttccacgattgcacactgtggcatcatggaaattccatgatttcttgagattctaagtgaatgaaaagaagccggtttagtggctaagcttactttatgtgtaatctattaaatcgtgtctaacttcctggtccatccacctgctgtattccattctatatctatattagactggaaacattaacaaatggtgaaagcataaaatatgtaaagtgcatgaagcactcaggactgtcaaaattatttctttcatatatatgtcaccatgctggcttttaggaaaaatatagctaaatataagtgtaattgtttcttccttatgtttcattgagttctatcataaaacaaacaatcaactttgaaatgtacttaaagttctacttctttttctttcttttatagcctttggttcatgtatacctgattgagagaggtgtaatttttcagaacgtataagtttaagtattaaaatactaaaaggtatgtttatgatttagaaaaagaacaatccataagcgtatttttcccctttacttgttgatgagtttttgtctcattgagtcgtcagaaaacattgtgtttattggaatttcatacattacacttcggtgtgggccggaaggaaagctaccacatatggtccttcattcctgggattacgatcagtcaaccatggttataaatggctttggttgtagagaatcttagtgagaaggtaaacatgtatgcataatgtctaaaattagaggaagcaaaataatgaccaaggcattttggttttatcaataatattgcagtctttagtttaaacaaaaatattttctgctattatgattaagtaagctaaagaaagttatagcttttgctaaaaacatacataaggatattggcaagagcacaggaaataaacaaaatccatctagatttatcaaaattatgtgagaatgatgtttgacaaggatgtctggattaaactgaagcctaatctccaacatttaaagcatgtagctagttattttttatttttattaacatttacattgttgaaaaaatgtttattaatgtggagtgaggataggatcccttgttaagggatgggtaagatagaaaggtaggagacattcaaaaagtatggttttctcaaacccagaagagttgggaaaacaagtactggaattctcctccaattacacttcaaacctgctaaaaattcaacaggtgaatagttgcctcagatctgcttacccagagcaaacgccacttaatccaatatgatgataataataattacataattgctatgtgccaggcactgctttatccactttaaatagtgactcattttgtctttaaaactgctcagtgagggagtactattactatcttcactctacagatgaagaacagaggttcagaaaacttcactggcctgttcaaatcacacagccagttgactacaaaatcaacagatgaagcccaggcagtgtagctccagaattatggctcctaatctctgttgtgtagtctgagattctcatgtaatctacaccatagctcaggatcagaatgtagaaactggatccctgcagaaggaaaaaatgatgaaattcataaataaaggatcttgaaagaatgtcttatgttattgtggtgtgatatattttgaacacacttcactataagcttgtgaaagaggaaggtaagacatggctaatccactttgtaagtgaggaacagatacagtgtgcagtgaaaggtagagtgatttttcccaaaaggtcatacaggtagtacttatgcaatgtggagcagattaattatgttttaacattaattttttaaatattgaatagatctataattatcttttttattatatcagtttggatcacatttctttggagaataggcagctatcacccatgactatggttatagtaattttaaagcagtatattcttataaaacacaattaaccaaaaatcaagtgctcatcattgaatcgccttctcttctcttctcttttctcttctcttctctctcttctcttctcttctcctcttctcttctcttctctccccttccctcccctcccgtcccctcccctcccctctccttctctcccctcctctcctgtcctctcctcttctcttcatcgaatcacctttctcttttaggtactgcaaagtctgtgaattcagatagccttttgtcaaatgtcgttgtcagataatgatagtaatctagatgagtttttataatctttggcaccatcttcataaagtacataaatcaggagaacgtataagcaccacgtgagcaatctctttccaaactcatgctctttgctgggcctgtaatggtagcatctatgctaaaaactagcattaaaacattttgtagaagcctaagacctaaatgtttcaaatatttaaaatatattacttaaaatcattcacagtcaagtatcttgaggcttttatgttttttgattagtctcttaattatcaaagagttttcttgatttgcatactttatggagatgttgatggaaaactactctaaacacaattttaaaatattcagatttgtataatattaaagctcgaagagcctagaaagcttcagaaatgaccttttatttggtaggccaaaatatgtctgagatcagaaaaactcaaggaatcatacatgaaagattccacagctgctttcagaacattacctttatatgtagactgcttgctgctttatttattttccaggatatatcaataggtagttgtaaatgtttgaacattacaatgtcatgaacccagtagaataatgcaggttcagatatggcatgacttgctcagagtggcttagccaataggtaccaaactgcactcaaatccagtgttgtggacttcacttcataacaatatgctacttcaatttatatattaaaccaaaagtgtccaagtttccctttaaaactagaatttactggctgggtgcagtggctcacatctgtaatcccagcactttgggaggctgaagtgggtggatcacctgaggtcaggagtttgagaccagcctggccaacatagcgaaaccacatctctactaaaaatacaaaaattaggtgggcgtggtggcatgcacctgtaatcccagctactcaggaggctgaggcaggagaatcacttgaatctgggaggcggaggatgcagtgagctgagattgtgccactgcactccggcctgggtgacagagtgagactctgtctcaaaaataaataaataaataaataaacaaacaaacaaacaaatagaatttacttttattttgtggtggcttgagcaaaagtcatttccaatgtgaggcttaaatattgaaggtgttctctggaacacagtaattatgagaaggagttcagaaatgaaacttacaaaaatatattttgaggaaaaacaaaataaaagagtcttgattcctaatcattttgtaatttatcccttatcattactcttgatttcttaattccttattgaaagtggtatatggcttatttttaaactagtatactgattttaaaatacacttttttgaaaaatcacttaaatattttagaaaatttcttatgccaagtggggtactccaaaagtaaaaaatctatatttctgaaaactgttagctttcattagtatttggcagtctaagagggtgtcttttgtaagtgtacatcactcggcataatggattcttgataaggtagacccaaattaagtttgggtaaatcagaaaaaagaaattctcacaaatacccacattgagttatagaaaatgaaatatttacaaactgaataaatatcacttatgtgtttgttttacttgtagtctttttgagtattttaagttttctttaaaataagttaagcaattatttaaaaagatgtatataaacctttagttccacttgcctatttgactaagaaaaaattcaatatcatactttttttgaggtaccatatgctaaaattcaatctgaatataaaattttttaaagaaagaatcaacctgtttctgagtgacttctgggtaaacaatgaaattaaggcagaaatcaataaattctttgaaactaacatgagaaaaagatacaacatatcaaaatatctgggacagccaaagcagtgttgagtggggagtttataccagtaaacatccacatcaaaaagttagaaagatttcatattaacctaacatcacaattagaggaactagataaccaagagtaaaccagccccaggtctaacagaagacaagaaaataatcaaaactagagctgaagtgaaggaagttgaggcatgaaaaccatacaaaagatcagtgaattcatgagctggctatttggaagaattaataagataggtagaccactagctaggctaataaagaaaaaaagagaaagtttaaataaacacaatcagaaatgacaaagggggcattaccaccgaccccacagaaatacagaaaaccctcagagactgttataagcaccgatatgcgcataagctagaaaacatagaagaaattgataaattcctggaaacatataacttctcaatattgaaccaggaagagattgaatctctgaacagaccaataacaagttctgaaatggaataaaaattaaaaagcctaccaaccagaaaaaaaccaggatcagacagatgcatagctgaattccaccttccttgtataaggaagaactggtatcattcctattgaaactattccaaagaattttctaaaacttgattataaacatttagaaattaagacttcatagattatctaatctctacctttattttgtagatggggaaactgaggttcagatatggcatgacttgctcagagtcacttagccaataggttccaaactgcactgaaatccagtgttgtggacttcactccataacaatatgctacttcaatttatatattaaaccaaaagggtccaatctttcagcttccatgggccacattgggagaagaattgtcttgggccacacataaaatacaccaacactaacaatagctgatgtgcaaaaaaaaaaaaaaaaaaaaaatctgaaaatctcataatgttttaagaaagtttttgaatttgtgttgggccatgttcaaagttgtcctgggccacatgcagtctgtgggccgtgggttggattggacaagcttgtattatactgtcttagggttttcacaaagattcagagaaattcacaactcctgccctataatttttattaccaactatacagtggggtaaaaactataaattgaactgtcattcatgcccacatgaattagtgaagactttctgcaacttaattaaaacacttccactttctcagcatcattatatctagaatcatgagtaacatagcaattcagcattcctgacattgaatattaagtgtaatgattaaagagaacaaaccatgagctttctcatattgtgttgaaatttttcttttcaattggtccttgtatataaacacagatacaccaaaagggaaaaatagtcaaatactattgaataaataaaacaaattccatgaaaatatcaaattgagatgttgaattagaatgaaacaagaattcgaggtcagcagcaacagtttgtccaactttttctgtcctgaaagcgccttgtatagtgatcttggcttgctgaatatcattgtgatacaattcaagtgaagttggcacatgccaactcaggtggaatcctaaggtccctctcatgtcttgagatgcaccattggctaattcttcatgctcaggaaaatacagcaaaagcacacacagaaagatgagtcctgtgtcttggtaggataaagtcagagaagaggtagagaaaattctgggggatgtccctagagaatatgatcatacattaagtaatctttacattgatttaatctttacactgatggctagctctgttctacgaaaagacacttgcattcatttgtctgtcaaagtactattcacatagaatcaaccaaggcacacatcagtggtggattggataaagaaagtgcggttcatgtactccatggactactatgcagtcatcaaaaggaacaaaatcatgtcctttgcagcagtatggatgcagctggaggccattaccctaagtgaattaacgcaggaacaggaaaccaaatactgcatgttctcatttataagtgggagctaaaactgtgtactcatggaaataaagatggcaatgatagatactggggactacaagaggtggtagggaggaagtggggagggcatgggctgaaatgctaactgagtactatgctcactacctgagtgatgggatcagttggaccccaaacctcagcgttatgcaatatatgcatgtaatacacttgtacttgtaccccctgaacctacaatgaacgtagtttcaatctcacagtgaactatgtttgaaaatgttcaagaaaatatcaaagtgtccttccattgaaaggaataactagcacacacacaaaaataaaattgcaagcttgttagcctcaaataaattaactggcagatttcattttgtctgttcttcattgtttgaatatacagtaatcccccttatctttgggggatatgttccaagtcccccagtggatacatgaaaccacagatagtactcaaccctgtgtatactatgtttttcctgtgggataacagacatggctactatgtggaaaacggataagtggtctgtgcagattaagtatgctggacaaaaggatgattcatgtctccagttggcacaaagctagatggcacaaaatttcatcatgttactcagaacaacacacaatttaaaacttatgaattgtttatttctggaatttttcatttaatatttttgggtcacagttggccacgagtaactaaaaccacagaaagcaaaactgtggataagcaggaactacagtactagaagtcttaagaaaaggaaaccagccaggcacaggggctcacgcctgtaatcccagaactttgggaggccgacgtgggcggatcacgaggtcaggagatcgagaccatctggctaacatggtgaaaccccatctctactaaaaatacaaaaattagccaggcgtggtggcgggcgcctgtagtcccagctacttgggaggctgaggcaggagaatggcgtgaacctgtgaggcagagcttgtagtgagccgagatggcgccactgcactccagcttgggcgacagagcgagactccgtcttaaaaaaaaaaaaaaataaaaataaggaaatctttcttgatctctgagagggcccttttcctgatatgtatctgaagtcggcattcagtcattgaatcataggtttgccttggccttttccccaacacagtttgtactttcacctggagcagcaagatgtagatacaggacccagctgttgctgtgaactgattatacaagtttccacttatctcagccttagtatgaatatttcgcactctgcgatgtgattttggagttattgcaatcttaaccaaattttaaaaatcatggcttagatcaggtgataaataatcctaatgcacccagccttcgttagaacgattcctggagttttgcacatagttctaggcactactttataagaatgtaattgaaaagtgctcatgacctttctcgttgtaccattcatctcattttaaattatcatgcttaaagtgtttgcctttcttagcagactttaatctccatgaatgaaagtgctgggtttttcattcatctgcatatctccagtgcctggcatgtagtaggtgcttaagtaatatttattgaatgaataaagatggaaactaaaataatgaaagttagggaaactgtgtacacaggaagtggctgaatcggggatgtttctggagaaaggactgccttaggtgggggatataaacgtcatcttcaaatatttgaaaggaccatgaatggaagagggattttttaattttatgttattccagggagaaatataaagatctgttactgggttaaactactggtaagtgttttggttcaggagaacttaaaaataaattagagtgttcacacatgagcaaagcccttgcaaagtatcaagctctctgtcaccagtagtgttcacagagagatgagataaacattgcagtgatgggtgatagagcaaattctttcatctgttggagggtaagcatgctgcctttgaagtcctctccaactatgactgtgtaactttgatataattgagcacttgatgatttccacttgctgcttgtaaatgttattttttgtcttttaaagatgcttcctaatttcatttgaaaatccatttccttattgttctagctgtgagttctttttcctaggcagacaatgattggttaaaaaaatattgaatgaagtgtgatttaagtacagtttaccattgatttaaatttacacaaataattcctattatatttttagtgcattaaattaggcataggtggataataaaaaataacttggatttgccatatattataaattgctttttcttaccacagacattagcatctgcttgtacttaatttttattcagggggaacttatttaagtctttttcaggtggataaaacagacatgtggccaagattacttaagccactacactgtaattatctcactattgattacttactgattttctgtctcttttattttgattctatgcataggtaggccctcgacgggactggttagtgtataatccagctttgtctggtcttcgaatgctatagttttacatgaaacaaaaataacagcatcataatagacagctcaaagcatattatcacctttctaagtatctgcatgtctaactctgtcaagattaatctctctctgttccccagctgcttctgaaacaggcctggtcttaaatctcaaccctatgacttcattgcttactcctagagccatctctacaaaaatttatttgccaaacctaaggagtaaggaaagctataaaaagaaagttatataagatggaccatgtgtaaataatcacgctaagtatataatgtttacaagaaagtggtaaggcattttaagaataaaatcacatcaaaacctatttgtccatgggaaccagactgcagagtaatgtgtgtttgggtttggaggtgatagatccaaccctatgacaacagtgaataaaggttgttggtaatttagtaccagaccttgagtcatctgtcactgtgaaggcctggaagaatgcatgtcctacaagtcatcttggttagaaaaagcagctgaggcagacacttttctaaaagtttgcctttgtagaacaaaattcatttgtcaaatgaaaggtctttctcatgttcttaaaacattgtccacccactcaataaataaggactggaaaaccttcaccaaaattcaagaaacatttaatgaatgtctgtgatgtatgagataacttcccaatatctaaagtttatcatcagaattcattgcacctctgcagaaggtattgagagaaggaaagggcatatgtggctgattggtccaaggtgccccttctgggctgtagggacgagtctattttggaacaggtcaatacaagtaaaatcgaaattctttagaattctttatctttcctgtgagattttcagactctctgtagcagtaaacattcaaacatcatgactgataggatgaaagattagattttatgcccttgtgacaggagaaaaaggtagagtttatgtgtgtgttgtcagagaaaaaaaaaaaaaagcctagcaagtttgggctattagaccctagactggcaggcctctgtcctcagcagtgcttgatcatgaggcatcttgatctgatctaggccagacttccagtttagatcagggcctctgctaatatttggagttgaaattcagcctggcttggcaactttgattgactgtggcctcggagatcgaggacattcccagaagtctaggtcagctgagcaacagggagtgttcatgataattaaaggctgtcagccttgtcagggctgctgaaatttcagcagaggctttagataaggatgattattgtttactaggccaagtgaacaatgatcactactcccctacagacatttatcacatactcagtacatgtctatggagtgcctgctactttctaggctctattctaagcactgtggatgcagcaatgaacatgcttgcttttatgcagtttacattttggtagaagaagccaaacaatgaaaaaatatgtaatgtcaagggatgataaatgcaatgatggaaaacaaagcagagtacagagtgacttggtaagggaaatgttactttagtaaggtcaagaaaagtttctatgataaattgatataagatcagaaatctaatgggaaaatggagtatgcaatacatagatcggagaagaaagcattccagcaatatgcaaagataaagtgtgctcagagcaagcaggccaggatactgaaggggagtaaagagtaaacagagagaatacagtaagaaatgagtccagagagggaggtgaagaaaatatcatgtgggacttttaggtcatgctaagaacttagtgtttcctttgacagagatgagaagtcattgaaggattgtgaacaagggaagtaacatgacatgactttatatgctattgtgagaatagactgtaatgtggtacaattcaaaacagaccagttaggaggctcttataatagaatggttaagagaatgtggtgggacgccagtgaaacggtggagtaagggcctctaaaaattctctcctccatcaaagcaataagaaaactggcagccaggtgtggtggctcatgcctacaatcccagcactttgggaggccgaggcagtggatcatctgaggtcaggagttcgagaccagcctggctaacatggcgaaaccccgtctctactaaaaatacaaaaattagccgggtgtggtggcaggtgcctgtaatcccagctacttgggaggctgaggcaggagaatcacttgaacccaggaggctgggttgccgtgagctgagatcacaccattgcactccagcctgggtgacaagagtaaaattccatctcaaaaaaaaaaaaaaaagaaagaaaactggcaaaatggtcagaataaacttgtttggaagtctagaaattaagtaaagtcttatagaagtcaaggtgcacttattcaagaaaaacagctgaatgttggtaagaacaatgagctttgtaatatttaattcacttgagtcccattccctgctctccagatctacaacagtattgataaagaagagctcacattctcactgcagcctggcaagcatcagagagggaagaatggagctagagcttactcaaatcctcactcccacagaactgtcagtatttgacctgtcttttttactcgatagacctcacttgcacaactctctgtacttgacattactcagagctaccaagtgagaaaagcctttgctcagaggattgtgtgttaaaacaattggagggaagtattttaattttgtgtctgcctagatggatggataacaattgtggcaatcagtagaataaccagaaaactttaaaggaaaatcttgggaatgaattgtccgtaggagcttaaaagctttgagatatttctgagaacctagaaggacatacacaggtataaggctgagtacctgtccagggctgtgcctgctcagggaaaacctgagaggccctaaacactcacctttggtcaatcttgaggctctgcagaaacaggaagtgaagtctaatgcagagttgcagatgccttgatgattgttgaaagtatgtctcaacacacacatagagtccctcagcaaagacagaagattggttaggaatgaatagatgaccactgagttactctactaagttaacaaagcagagacttcagtggctgcatacagcaaagaatgtgtactttacaggattattccagaatagtcatcaaacaaacacaactacagcaagaaataactgcaaaccctgggtaagaccgtaagtgcattcccagagttgccacattaccatgttcaaaatatccagttcttaaataccacgacattcaaaggcacaaaaaaacagtggcccattcaaaggggaaaaagcaatcaatagcaactatttctagagaatcctagatgttgaacttactagacaatgactttaaatcaggtatttaaaatatgctcaaataactaaagaaaatattgtctgaagaactaaagtgtaagaatgatatcttgccaaatagagaatatcaagagatggaaattattataaaaatagaaattctgaagttgaaaagtataataacctaaaagaaaaattcacaagatcagagttgagccaatagaagaaagaatcaccagccaacttgaaaatgggtcaattgaggttattcagtgagagtaacagaaataaaaaagtacgaagaaaactgagcagagcctcagatgcctgtgggaaattgtcaagcagaccttgctgctcatactcataagtgtgatcttccaaaagagaatagagagacaaagaagcaagaagaataactgaggaaataatggcagaacactttctaaatttgcttaaaaacattaatcttcacatccaagaagttcagtgaactccaagtaggatgaattcaaagaaaattataatggacacattataattaaactatcaaaaggcaaagaccaagagagaattttgaaaggagcaaaataaagatggcttctcatggacaaagagcgtgggcaggtggttcattatgaaagaagagagacagagtccatgggcacaggcgcagatgggatggcagttttggtggtgggaacatgtggaaatcctttctcttctaatgcttccattttttcaaagaagttaggcataagaccaccaactcagaattggagggagagcaggagaggaagaatggaggcataaagatcactagcaatttttttgcaaggtcaagcagtactgaagtcaaaccaatgatataattcacaatgcaccgattgttcattgctattagcaatgcatggaatgtggggagcttcatccttgaactaattatttgttgactgacactgaactttttacattaatttaaatgcttaaatcttaaaatgtcagtactctgggcaaagtccctgctgtccaccctacttggcaggaagattaaacctctgctaaattatacttttacgttctctgaataacccctgcatacctttccctgggctgcattttttgcctgtatgttgcctgaggtcacaatctgggaaccatgaggcaacttggactaggagacatatatatatttacctgtacaacatctttacaaaagaaaaaggatcattggcaatattcaataatgaagagacttttagatgaaaatctgtgtttctggttcctggggtctgaggaaaatctgacacagtgaaccaggctgagagcaactggctggagctaggcagcaaccggcctcttttcagggatctgcacttcacatatgggctttgcaaaccttggtgcagtccattttcacttcatagaatgagtgaacttctcttctgttactgaatgcccaaaacattccagtcattcccataaagactgctttctcccagctatttgtgttcccaaagttcctaccacattttgtaggttcaaatgttatagcacttctcatcttctatctttatgaacttatttgttctacctttttgtctctccttttagatttttaagctgtttagagggagggttggcattttaatccatttttacaatttcactcacagctaataaatgtttctgtataaacaggatcaacaaaatgtgcaatgaataataagtttggtccattataatttggtttaagagactatagtaaattttgaatctatcttaggcacagtggaatgcttattagcaattaatattgatgttacctcagaaaatgttgaaaatctattcaattcaccttggaatgcacaggtacttagcagacaaacaaaatccctagtatgttctacactatcatattataacagtgctttttaagtcttgtcgtggaagctagcaggcatattctaaaatgttgaatgcaaatttgttatcaaaactcatgcccttggactgtattctgtggcatctaaatctatatacagcatggaaagctataccaactattggtggtttgtttattctccttgccactaaagctgaatctttgtccctaaatgctgtcattttatatgcaatttttcttttgctttgtgtgtatttgttgtatatatcgtagtcttctctcatccatgggaaatatgttctaaaatccccagtggctacctgaaactgtatataacaccagactctctctatattatgtctatagtatatctgtgataaagtttaatttataaattaggtagagtaaaagattaacaataaataaagtagaacaattttaacaatatcctgtaattagttatataaatattgtctctatgaaaatactgtaataaagactgtagctgaccacaggtaactgaaactgtgaaaggtgaaactacagaaagaaaaactgcagatgagggggaatactgtaccacagatacacacaaaactggggatattcctaggacataaagaggacttccatgggaaacctagtgaaatccacataagtgatttagtgaatcacaatgcaccactgttgccttctttagttcgacaaatgtaccttgatattgttaagatgttaacaatggaggaaactgggtgaggagtatgtgggaattctccatactgtctgtgcaacctccctgtagctctacaaatattacaaaataaggtttctctaaaaatcaataaatagaagttggtgcaatgtttggaaagtattctcaaattaaaactcagaaagctggtgccatctgacaactctcctgagtttgggaggtcctgttgctgataacagcgtatttcatcaaataattatcaatgtctaatcttcctacatacaagtatacttaaatgtatatatttggattcacacagaagcaagttagaaaagaagtcactgatatttaattcataaagtaacatttaaaaaatcagttactatgtgggccgtctttttgttcagtgacattttattgcctgatagaagcgtagtgctaaagagtatctatcttaagtgccagttagaatgttctatttgaagatagtaacagatatatcctaatgatattttaaatcttctaatgtaagaaaagtctcccgtgatgggtcaggaagatcctcaagtataacggtttttgaaaagcaaaatagttgtttattgtcaactgaactttccagttttttagtcctgactctgaaaagtgttaaaagtagaatctttcttgatactattgacatttcacaggcctaaatgtatcattcaattatttgcactttgtaagaaagatatacctgtgaattatgcatcctagagatatttcataatgaaacttacaatttatttgcaaaaataactgggagtattatttataggtgaagatagaattggcatttcaatgtactgagcttagcatgtagaaggagttttcttatgctatatcctaagtgacattttgcctatttggaaaacattttaaagacagattaaatatcgcatttccaactctcaaatggaaaggtatcactttacagctttattattttcaaatattcaagctcaaacagttttatagattaaagagattgcttaactcaataaaatccagaattctaagtttacatctttcttaaattatcattattgtatacgttgcaagtaacataacatcatcagatttataccataattgtaagatgcaaatgtataattactagaatttaacctccccaaaatgatgtaattcaacctgactatcctggctacataaatgcaagctaatcggcaatgaaacatttaaataaaacaagaacgttaacacaacaacaactgcagaataaacaaacttttcaagaaggaaaaaaacaagggcctaattatatctgcaacaaaaaatcataaatgcctactattttaaagtattttcccgtccattcagactttagctgtggccaggactgtttcaatatgtgttttgacctctacgtacattgatagtcattttcctatattaatttcttcattcagtaaaccatccaatgtctccttcattcagtaaacatttattcttggacagctgtgagttgaacaatgtgaaggtgttgaagatgaaggagaagcagcagttcctgctcttggtctaattacttgtttaaataaaactaattcaaatataagagatactttcattttagggcacggtagctcacgcctataatcctagcactttgagaggctgaggcaggtggatcacttgaggtcaggagttcgagaccagcctggccaacatggtgaaaccccatttctactaaaaatacaaaaattagccaggtgtggtggcacacacctgtaatcccagctacttgggaggctaaggcaggagaatctcttgaacctaggaggcagaggtttagtgagccaagatcgcgcaccactgcactccagcctggggcaacagagcgagagtccatctaaaaagaaaaaagaaagaaaaaaaagttttgagagacacgatagcaaggtaatttccagggtttctagattgggtgaatctcagagcacagtgaaaacaggagctttaaacaaattggaagagaaccttaacgaaagttcaagttaataatgtattattattattattgaaggtttttggacagaggaaatttgaaaaagcaagtcaattgttttcctcaagtaatagtttaatatagatatgaaaattattttatatgacctattactaatgcagtagtatctacctttctttccaatgaccaatttttctccaaaatatgtgatttacgtttccttaatttcattaaagatcagtgttttcgtctctaagatagtaatatgtagatacttagtactcagatgtcaaacaactgaactgagaaaggtccaaaataaatgtctgtgcaaatgagccatatgcatctgggttaaaggacaatgacaaagtcttaaccagtcctgcggtttccagctcataccctgacacaagaaagggcaaggagagttgtgtttaatagtatattcttcaattaaatgtcacttttcttcaatgtgtactctgggtgagcacactaaaatcatgttttgctgcaatgtcatcacaccaagttgctgactttcttgttgccatagcacatggtacaaagatgaattctgccataggataaacttaggtcttaaaagcctcatatcatggagtataatgcatattcttcttttgcaatccatagttctaacatctctatttctcccttttatgttattagcaatcactcatatcacatgtggatgagagttaaataaattgaaaaggcattactactgctcttaaaaaaaaagagagagatactctcattttaaaaggttaatcagatcacacatttgcttgcttaaatttctcaaatatctttccattgggcttaaattcgaatccatggcctaacaatgggctacagtgctctataggacctgcctccgacctctcacctcacttcttttcctgctctccagctctaccctacagcaagcacaggagcttcatttttatttctcagaggtacttgactaattcctgcctcaggacctttgcacttgctcttgctgcttctgcctagaatgttgcttcttgcctcctcattcccaagtcctaaccaagtcagagattctggttagtgctttcctcatactatttcattgcatttattaaaaactgcatcaccacaaagagattacatacttctttagaaaagaaaagttggagaaatcctaagaattttgtggcaatgaaatcacaatcatgatcagaaaccttatgaaaacaaaggtacaacacctgtaaagtcctatagctaatttaaattatcagaaatctcataaattagtgctcctttttgatcagtgtaaaaatacttgacaaaaaatataattggctctgtcataaatgtatctgaagtcaatatgtaagctataacaaagcatcacacttttcattaactaattttttactgtttagaatttacaaggctttggaggaagataatttggaacttccaggtctcctttaaaatcatataaaataggttgtgtttatgtccttttctctcagtgaattatttttacatcaaagagagtaaccatgatgctcaataaataaaataaaaataaataaaatattatttcattgaaaagagtttttattttatttatttatttatttttgagacaaggtttcactttgtcacccagactggagtgcagtggcacgagctcgtctcactgcagccttgaccttctgatctcaagcaatcatcctcccacctcagcctctcaagcagctggggactgcaattgcacaccaccatgcctggctaatttttttgcattttttgttagagagggggtttcaccatgttgcccaggctggtcttcaattcctgagctccagtgatccacccgcctcagagtttttatttttaattgagtttaaccagcacatttttccttcatttttttcttacataagttcagccacaagtaattattatttgaccagaatcctgattctaagaagtagtcatgagacttaagaaatatcattttatttacttgtttatttaacacctgatattttgtctaaatgtatctaatgcaacaataatgttaatcgaatataaatataaacagaaattaggatcatgaaaatagaagggaaaatacactaaccaggaaaggtgaaattttaggcagaaagtgattcagcctcagtagatctcagttttatcatttaatctagatcaaggaagataagtatgtcctcccttgtgtgccaaaccagttttgttggaagaggagtttgcactgtgttaagaagtgtcttgaggccaggtaagagctcaccagggagcaatgaagagatgtttccttgaggtccaccaagcccacagaatttggaaatggcagcacatttgctgtgcattggcaatgcctggacaagattacagttgccagtcattttctaaagtttcttcattgttgttctacaatttctcactgttcagtgaaagccatttgctaaaagtgaaaaatattccaaatttagtatttatttattcaaattttcttgtaatttaattttaataaatgcattatgagtgtatggccaccacttttctttcctaatgttcttataatttgagttctgcttaatgtcatgtttatgtttctgggtaagatttctggaagtaactggcatcatcagaatgaatttgtcatcccccgtcttaattccgatctctttgcaagtttctcaaaattggatcaactaattctgagtaatgcaaccctaatcccagcacctagtagacatctactaggttggatatctgcattcttcccaataatcaaatttattcttgtctaacccaacgttctgttacttttcaatccctgaatgcctaggacttctccaccctcctctggcctgtcacctgtgttggcctggactgtaagtctttattatttcctgaaatatgctactgattccttctgagacttcacacctccgagcctagaaccccattctaaaatagtatcaatggattagagtttagtgtcatgccttctgatttcttatcaactccaattccctaggaatagattctaatcttgaataataatggcaatactagaaaacatgttttgaacacagactctaggctattaggcaatacctgggattatctcatccttaaaaaacaatgtatgaaacagttattcatcttatgtgtgagagcataggaaagttaagtagcttgcccaaagtcacaaagcaagtcaatgatacagttgaatatgaaccaagttatctgaatatgaacgtgagctctctactctactgccccactggttttactaacattctgctcttgctggacaggttgcaggcagagtgcggacacagagaagacctgccttgtcaagactggcgcccaataagacctctagattgggcccttcccctttcatctccccttactatttttatgactttatttttaaatgtgtacaaagagctttgcttggtactgaggatatgtaactcacaaggcaggcatggtcccttccatccaccttagaggcttttagaggaaagaaaccttcatcacctaattttacaaagaattgcacatccagagtagtgataagctctactaagaaagattgcagtgtacagtaaaagcctacaacaggatgacctaacctattctggcaggtcagggaattgctgcatctctcatcaactccattgtatggctcaatacttactgtgtggttcacacatcacttctcttccaggttaaactacaacaaagtgtcttcagcagaattctagctttgagttgcacagatcctggtatgctttgcagctctcccaattccccgcagcctcttctttactaatagaggttttactaaatatatttattaacatatttcaagctaccattaccttatcagacctctactctgctgaaatactgagcaatattgttttattgattgggtacctactgatggtagcaatatgcaagtgtgcattattctcatatgactacagctttaatagtctggaggtaatattgaaagtaatttactgtcgtctatagatggcagttctagtgctgtggtacttagggctgccaatttggaaattccagtatgcatacaaatgagttattggaagtctttttagaactaacttgataaaacaaaagggcaagaaagcccaccactgacctgatagccatccacaaatatagtaattgggaacaatttctttggaatgaatgacagataccttttccattatcttaagttttctagtagaatcaatgacaggggctgaaagagtttgtggacatgttgacttaatttaatgtctaaatcctgaatctttttgctaactgcagatgcaggatttagacactaaattaagtcaacattttcacaaactcatggattgcagaattctcctgcattgcagtgttcatcacatgagctgaaggcagagcagagatttagacaatgaaaatactgaaacattgtttttcccccaccagtgataacgttaagatgtttcgtatatcaaattattcaatattttatattatcaagggaacaatattaaatagaagcaagcagaaagcctactctctcacatacaaaaaatattattttatattctttgcttcctttggcctaaatgcagttaaaaaaaaaacaacttaggttctataaatatgtgtagatcttattgatccattttaactgctagatagcattgatagcatcccactgaatgaataaatcacatttatgtaaacattgtacaacagagggacaattaggatgttttccttttttaaaaaaactaaaacacacagacattcagtgaaaaattctgtacatatttcctgtgcttatctagtttctcttggatagacacccataaaaagtgggggaaaaccaacttgtgaaaaaaatgtgcagtaggattgcaattatctaaatctttaaaactcacaaacattgtttatggatgaatttattcatagtgtagaagttcataaacatgcatgaaaatgatccacaccattttcaagagagtggatagtcctggggagggcgggttaaaggatgagagtagcactttagcaatatctgtaacaatttacttctctaaaaaaaaaaaatgatctggagcaaattgcaatatgttaacatctgtttgatcctggtgatgataattacatagatgctgtatttttcctatactcttaaatatgcttgaaatgttttgtaagttctgtgaaaacgatgttttacgaaaagttgtcaatgttatttaaaaaaagaaaaatcttgtgtgtaccataagaacattagaattactgatacaatgccttatatgcaaacactcagctgtctcctgttggaggaagtatatatgagttagaaaaccagctgtgaaaagatatcaaatttcagctagtaatagggttcacataactatgaaactaaatggcactttctacttcagctcactgggggctgggcgcggtgactcacgtctataatcccagaacttggggaggccaaggagggaggatcaaagtttgagatcagcctgggcaacataggaagacctcacctccacaaaaattaaagaaaaagatagctgggtgtgctggagcgtgcctgtagtcccaggtactcagaaggctgagagaacaattgcttgagcccaagaggtcaagactatggtgagctatgatcgtgccagttagtgcactccagcttgctccagcctgggtgtcagagcaaggcaagaccctatctcaaaccaacaaacaaacaaacagcctgcgcccagcctgggtgtcagagcaaggcaagactctgtttaaaaaaaaaaaaaaaagtcttcagctcactgaactcactggggtgaaagggagctggagaaagtatctaaaaatctcaggagttcagggagctgacccaagtgcaacccaacaaggacaagccagcctcagtcctgggtgagctgaactcggttacagatttgattcaacccttgagtgggaaggaaggaatggggcctttaactccacatgaaataaaaactgaatcaggaataggctacaaggaaaaccagagcagaagatcctagaagcaaggaaggtgaagctgagtggggaagctgtgcaggcagtccatgcagggggagtcagcaagccagggtttgagtgatgggcaagataccaatctttctgagactcagtttatttatctcaaaacaagggtaacactatctggaggatattcttatgagaattaaatgaaataacatatgaaagtacttggcacctcaataaaggttagtatcacctcaacttagtagggtacatgctttcaagggtaggtcagggagaggagacagagaagcagccggcaggctttagctgaagttatctcaagcactgtctcagaagggatccaagaaaaatgccattgatgctgccactccccacatctgtcagtgggatccagggaagaataagtccattcagtgactgaaaagagttgcaaatgaatgaagaaggaacatattagattatgcatgcatctctcaaattggtcaagatgcggcagccacttaactcagttacacatgcttaggaaaagcttagcggtctgaccacaacactaagcaccaagaatgctcattcatgttccagacactgatccgcagtgcaggcaaggtgctcaaaggggagacttgagtttctgctgcatgagctgcaccaacacaaactcttctgtctctgctgtctgctctgcaaggctgtcttgtgctttaaaacattcactgcaatatacatttccagtggtcgattttgaaggcaagtaagagtctttaatataggcattctctatctactgctatgtttgcacattgctgctgtttaattctccttttattcaaattaaataccttgcagtcattcagaaactgtgccttctgttgccacatcttcctgctgtcagagcagctaattagctctttgcaggtcttagcttctgaagaacttgaaaggatgatttgtaattgtgcactgaagtacagcaagttgcttcaaataaacatggttaaaagtctattgcttgagatttgtcaatttttacacgatcatttatcattttcatttatttggcagcaatagaaaaatcttattcgtttcactttcctgaaggtagagccatcatcatttcttatacttgaacaaaggaagactgtaaaaacctgaggaaaaacataaaaaggaaaatggggccttattgaagcaaaaagccctataaaatctgaaaaggacttctctatggaagacctataccataaaattgattcttattgctactgttacctttaaaggggtcaaaaatgggagcttataaagaatctttcttattcatctttgccagcagaatgaaatccattcttcttagattggcattcagaacccttagggattttgaacttgacacatttctctgatcgtttctcctggtacttgtctgcatatacattatgtggcaatttttgaacatctcagtctttccttaatagcctacctcaatttttactttcttcctgagtcctttccctacactactaatggtcactctttcccagggatacagttagcaaataaatatacaaaatgctcagtttcaatttgaatttcagagaggtaagaaataattttaatatgtctattttgtgcaatatttaggatatacttctactaaatatggattatttttatatctgaaattttcctacctgtgtcactgttttgtatcgagcaaccttacttccttctctgaactcttgagagacttgttgtcctcatgacttacttgtcacctggcatttccaacctaatgttgttgtggtcttcagtcagattttaagctccttggaaatgtagtggaatcccactttcaattaggatacagaaaggtgtaaaagatcttcattcatgtgatcaaaccccagaaatcaccaagcagacatagaaacaaaaaatatatacttttccttaaagatgttgaagcacagtgggcacaaagaaatcttatgtgaactaagcaccagagggacaaactcttggaggtgagaccagttcctaagacagggagcacagggaagccagctgctagagaagggcagtctttgttgtgtccaaaagaaacctgcaaacgctggacaaatctgtgtgctggcaggtcacttttgaatctgaaggagcctactaattccctctcatagaattttactgaataagcagagaatgggagctggattggcaaacgtacaaagaccacatggtcttatagccagaaaaaaagaccagttcttagagaggaataataataaatttaagaaacaatgacagcatgaagatagaacaaaaccttttaagtgctaaaacacaaaaactaaacaatatcatcaatctaaaatgttgtatactctaaaaatatgtttcaaaaattaaggttaaataaaaacattttcagataaacaaaagatgagagaaattgttgccaacagatcaaaatcatcaaaaatgctaaaaagagttttgtaagctaaagagatgaagtgccagatggaaatccagatctaataaggaataaagaaccccaataatggcaaatgaaagggtaaatataaaaggttattttttcttctaaatttttaaaaagtcaattaaaatttcttacagtatgtgagagatatatgaaatattaatttaaggtagatcatgataagttaagcatacatattgtaattctcagagcaatgactataaaataattttaaaagtcatagctaaaaagccagtagagagatactaaagcctactcatttatatcccctcctccctcccaaaactacaaactggaaagtaaaaacaaagaaacaaagaacagaagggataaaaaaagaataaagacaatgtgttccactcatagaacctcagctctcctctgtgaaataacacagttttcatgatgttcgtgatgagaataaagtgaaacaaaataagaaaattatttggaaacatacctgacacatgttaagtcttcatgatattaattattactatctctatctttgctataaatgactttaatattatgaatgaatgagaaagccacgacacttccatcccagccctgctcttcgtgggcccttctgtgagacttggctagaaggctgtgcctccatggtcatttctgttccagactttttttcaacagcttcattaaaatatagtttacatgccatatagttcacccaattaaagagtatgattcagtgatttttagtatatctacggagttttacagccatcacataagctaattttagaatgtttcatcatccctaaagaaagcttgtaccaattaggatcccagaatccaccctcaactgactgaacctctgctggtagactacacatatctgtactgtaacaagatcctacaagtgattctggagaatactaaagtttaatagctccaaaggcacatgtttatgatgggctcccaggtgtgatgcagcctaggggcccttggaaactcatgttgatataaaataaaaattcttgctaaggaatatgaacaaacatgttatctaactaatatgaagcacagtggagagtagtggttaagaacaagtactgtggcaggatggggtcagattacagctctcttcttgaacttgggcaagttactcaaactcatgcagcctccacttctgtgaaataacacaattttcatgagattcataataagaataaagtgaaacaaaataaggaaatttgaaaaaatacatggcacatatcaagtcccccagatgtcagtaattactatcatcattctagttaatatagttaatagctagggatttcagatgagggttgtactaggatgaatttggagcattctgctgctcaattctaagacaaagtaagaaggcttaagttttatgaccatggcatatatttcaagggaatgtagtgactaaaaaatagatatataaaagcacagagggaagtgacaagatagcacattgttcatcttattcagatagaatttagaagagttgagccctcacatttttgaaactgttattgtggaagcgttgactattgccatgttttgtttgctgttaaagaattgtagacccgtgcacatgttagacagttagtatctttttgtttctatggtgattttttgtagtttttttttttcatttgtttgttttgttgttttgagaatggagtctcgctctttcaccaggctggagtgtggtggcacaatctgggctcactgtaacctccacctcctaggttcaagcgattctcttgcctcagcctcctgagtagctgggactacaggcacgtgccaccatacccacctaatttttgtatttttaatagagacagggtttcaccatgttggccagggtggtctcgatgtcctgacctcgtgatcctcccgcctctgcctcccaaagtgctgggattacaggcgtgagctaccatacccggcctctatagtaatttaaaagtcattgtgccctgcctcatatacagcttttttgagtaacttactattatttttaacatctgttggcttgtccctgtctcttgctttaatgtaaaattcctgtggcccctttaaattgtcagcagaaagaaataaagtggcttgtgacaccaagacaggggaaatgaaaggcaaggaagaatgctgtgacttcagggtggaaagatatgcggtttgactacaaatgtatagtcagctttgattgagggaaacataggaagatacaggagcaatcagaggaaactcttacagatctcctgggcagaggaaaaagtcagggcaggaaatgttcctgcagagagatggggaggaaacagctggtgaaatgttagcgtatcaatcatgtgtggaaacacacatggagctgagccaggtgggagtgcaggctccttgcaggaatgagggcaaggatgggctcagatttacataattcacacacccgcaaatgtacgcatgcacacacacacaaacgcatgttttttggagccctttgccaaagacagtgacaacagtacatctattttgcactggcagtaaaaaaaaatgtgaaactggtgaattggatgaatgagtactgtaggctttccctgtgtgagccagggctcaggcaatgagggaaagagcaatgcaggctttattttctttgacttcgtggctctccgaaggcatgttctctcctccctgcctcagagtccgggaaactattccctcacaggatggttgcttatggccattccttttatatgtgcatatatggagcttccttgggtgatagaaatagtattgctaggagatgaggatgcttgcttcattttgtggagaaggctgctgtgaggtgtgtatttcaggacccaaaaagtaccacagagaaggaaaatggaatggagtaactcagcagtaaaatagaagttctagtcatgattccgtcaagatgtaatcaacaaggcaagaaccctgtgggcacaggccagaagctggggataagaggattgacattctgggacccagagaagaaaagcaggactgcctaaaacagtgaggggattagaacaatatttaaaaagcatgtaatttccagagccagccttgaacctggcaaacaaactaatatctgtgagctaaaatcaatacatatataacataattatttttatgtgaatagaggtatttattcccagaaaaggcaagctcacttccgtctgttcttaaaagggcactaatcccatcagaagttctccccactcatgacctaataacttcccaaatcctcatctccaaaaaccatcacattggagattagggtttcaacatatgcattttggaggggcacaaacatgtaactgataggagttattattattattattattaccatgttactgatgaggaaactgagacatagttaatcaactggtaactagtagagccgggtatccagctagttagtagttgctccagtatttaaaccaaggtgacacaggtccagaatctatgcatgcttttaaccattagactattatgccactatacaaagccaaggtcacagactccaatggccactgccaaaatgattgtctgttaccttggaagaaagtaaagtcatgcattgtgcagtaactctgtggatggccccataaaatatataattcacagaagaactgaaggtataagttttgaagtccttcacatccagcttcctgtcctgactctaccaacactaagtcatgcaatcatgcacttaccagagtctgcagcatgaagataagtgttactgtttgtggtatcatcattatcattattaataatctttattatcaatataaataaagtaatactttttcctttgtgcttcttaacctgatagtcctttaaaatcatctggaaaggttttaaaaaatatttatttcctgagccatacactaaaccaaataaaccagatgatcagggatggagtcagggttagggggttgctgacccgtatttttctaaaacttcccacacaattctgagttacagacagtaataaaaattgcattggtcaccaaatactcatagaactttcaaggtagtgtgctgggtatgacattttgctggacaccaaggaggttctcgcaaggaggttcttgtaagacacagcaccctgccctgtagagctctcagcataaagctttatggcattcacctggggagtaggcagggcctccactcctttatcttccaatccactgtttctgcttctcactgtgtgtctagtgtcgcctgcaggtgctagcctcatgaggccataaaatgcagggttgcactcgatatgtcactcaggctccttgttcaccaaacctgaggactttgaggattcattcctggacatgagtgtttcagtgggaaatgccttaaatctttatagatcaattgtgttattattatcactattattagaactgtagtttattaagcacctcttatatcctaggttctctgacaggtactctacctacattatctcatttggccccctaagcaacccagcaagaatggagctattatccaaattcggcaggtgaaggaactgacgtgagcaaatcaagttgccccaaatcacatggcttctacatggtgaagcctgaatttgaacccagatctgagttccaaaggccctgttccctccactgggtttgtattgtcatggctaagactgcccagctcttgctagaactgttagcagcttcttgccagatctggattcatcccaggttgtcctcagtcttgaaaataaaagatcagttttggtttctgagggcagaggggtgtcatatagggactaagaaggttccagaaacactggatgtgcccaacaggaacctttcaaaggtcagagaggagaaaaaaggtatctatggcctctgtgatcctgaggatcacggctgttaggagaagagatgaggaatgtcccagccctcagggtcccagagtaaatgtccagaagtaaataaaccttagatatgttattttacaagctccaatagttgcaaggttggtcaggatatttctgctccccgcctttcccagagaaattgtagacaataaggaaacaagtgagaaaggtaaaagaataggaaaaaatgagaaaaatcccagcgtttccccagaacattttggaatttagcttgattttattttgaatcaaagatgtttttaaaggaacactttgtttttatatagcatctcttttctcaaaaatttaaattggaattcagtcactgcatagccactatgctttacattaggaattcagtacttcttcatcttataactgaaggtttgtattctttgaccaatatttccccctttccccatctcccagaccctaataagcattgtgctactttccattactatgaatttgacttcttttagctgccacatacacctgagatcatctgagtagatctcacatgttctcaccacacacaaaaaaatgatagctgtgtgaggctatgttaattagtgcaatgtggtaatcatttaagaatgcatacatatatcagaacatcatattttatatcctaaatatatacaatttttgtctgtcaatcatactttaataaagctggggggaaaatcactccatagcttgccatgttacagtattttcaggataaggtcagggggaaagtaatgaagtaactaacttggctagttaggaaggaagcaatgtttggattaaaaaaaaaaaaaaaaaggaatagagaagaaaaatgatttccaagagtcctaacaggagagaaaaagcccgaccaagacattttcaaaatggccctaggagacggaagcttcagggctaattgaaaaaaaggccctagatttctatttaaatggcagtcctgagttgtacccagaaaatcatttcctgtattactttcagtctttctttaaagctagaaaccaaatccaaggactcatgaagtcaattgaataatgatgagcagtaggtcccacgtgggacctggggatggggcatgcattttctcagtgtcttagggaacagaaagtggagagacaaaattgagaagtgatcagaatggagtcattcttcagggatctgaaaagaggtaggagagggcaccctgaccgggaagtaactggcatcccaaaaaagtataaacagcctcaccttcctgaactgccagtgactataagataagatagccaagtagttatttaaaaactcaacatctcatgcttctcatatttataatcatcatttcattgtcatttcatgtttattgattgcctttgtcacatgtaattctaaatcctccccgatctagatagtcagattcttgagttttaatttcctctaacctggaggaggttagtaagtgttcaaagtatcctttgcatcattcctcatctcatacttaatgctccagcaacagtaataacttgtaattcctggtgtatccctcaccacctctgacctgcacaccccaccctcttcatcctccatttgtctagccatcttgcattcatcctggagggcacttctcaggtggcacttcctccgagaagcctcgagctggattatgtatccctctcatatggacatagatgttcctgtgcataactctatcattggacttaccatgtcatacattaactatctatttatttgtgttatcctgactagacctatgagatgcttgagggctgggcctgggtcttgctcatctttaaatccccaccagctagcacagaggcaggcccatagtaccatttggtaaaagtctgttgatgtgataaccaattaaactaaaaaaggatgaaattgataggaaacctttacaaaaggtcatctagaaatcgataccaataaccaagacttaaaaataatttccccttctctttatgacttggcagaacacaagacaaggggttcactaatcaaagaaatcatcgtatgctttgagatacaattaaatgtcaggtgtgataaagtcctatattggatagaaaattcctaactgtgaacaggttagactccattcaattgaaaatctaatttatttgaacctcagagtgtgtttaccgaatgaatctatgctgtgaatggtggttaggtggccacagtagctcaccagcccacaaaacccaatgcagcccataatgcagctgagcttctctcccctgtgaatacctctctgctgtttctctgcactcaaacatatcatgggccctgaggccttgtcgagattctcccatctccctatcgtcacttctaggaagatactttccattcctacacatagtctgcctttcactgttggttatcgttttctagcctcctcttttattccctctcacacatgtctttgctttctttattttttaattctaaggttaatttttatttcacacaaaaaagcaggcaaaacaatataaaacacgtttaaaggataatactgagtaagctttaagtggagcttgagtctgcaaaagcggtgagtccaaagggagagggaaggccatcttgctcctgggctgcattgaaggaaagaataaaggggacagcaagggactggcaatcccagactggtgccggctaatatcttacttccaccaatttcaatcatgcaaaaggtcaaattgtgctcagggagagctgtggtggggttgccaccctgaggagttgaagagtgagctcagtggcacactgggatggagcctggtgacagatgagcttggaatttcaaagggatagtctggcttagctttgcctgcaatgaccagcaagtcttccaaaatggattcagggaagagtgccagcctttggcctcaggagcctttctggtgagagattcatcacacccagcatgcacagtggccctggttggcaggccctcccttcggggtcaccgcagacctacatttgcaggggccggccgtgctagagttcaatcatgcactgacatcagggtttgcccatttcatcgatattactggggtaatattagcaggaattttactccagagctaggccttgccttttcatggctttttgttgttgtttttggagaagggagtcaggataggagggctgttgttgtttgcttgttttcaaatttttcaaaaggatgttataatctggagtcaggagaatttgaattaactcccacactgagcagtgcagtacgggagaagaaaacccaccagagacaccagagccgtctcttctcctttgcagagccttctcggctaaacacaacttgaagattttgaataaatttgggcaagaaaagaagcactgttgttttgaagcagattgcagcagtgatttttaaaacaaagaaagcagaactggagcatctttcatttttaatcctttaattacagtttacttggaccactgttgattgagaaaactgtagaaagttagtcactaccacaagcaaaaggcaggggatggatgtgtcctttctccacagtcctgctttgcagagtgttggagcacactgcggaggctctgctcacacgtggtggaatgcaccctggcagacttttgtccacaggtcgctttccccatgtttccttgtaaactcttcagcatttcataaagtattattcggctaggtgagccaggagtgtcaggctgagcagatgctcaggctgggtaaccaatgctggactggagtgtgtggtcatccctggttgctggctttctcttctcagtactaatttccaagcagacggacctccacttctagtcgatgttcgggtgatagatctttgttttaaatctggtcttttatgatttgaatgggtaatcttctcataggttgattttgattctgaaggccgccttatcctatggaggttgtcagggacaataagcccttgccgagtcaataaattagcttcttcaacctggatgttgcgggaggctttcattccgcatttgcagcttcttcaagctcctctaccagcctcctgttggctgccccctttccctagctggaacctaggatccagcttcttaatccttcttaaaatggtcccctcctctccatccctgtaagtcaagctcctgcattacaacagtactctcttaattagtctcactgcctcaacactggccccctggatctaccgtctaccttgcagacacaatcagcaaacagacctgttagtagacacgccaagtgaagggctgacagagaaacacatgttgacatgtcttcagcagatacacaagtcggtaggtgctgccctcctgtttcaagctctgtactggcttcctgtgcactcagggtaaagccagcccttcccacagtggcattcatggccctctctgatgggttcctcctgttttcctcactggactcatctcttgtcacctctcatctccctcgggatgctcttagcagactctaggctctttctatgtctgtttcaccccagtatttccctctttccaggatgtctcgcccccaggcatcttcctaccccaacacccaccatgccactcatccactaggtaagtatctactcatttttcacaatcattcagcttgaaggtctgcatcccatgaaggctttcctcattcaccattagttgaactacttctgctttctgctccgtggggtttggggcctgtgcagatcttggttatgaatagcccttttgttgtgatttttaatagagagggagcattgcatcttggttttgagcatctgctcagagctgaattttctgagttcatatctcaaatcttcgtttacaaactttccaatccaggacagattgcactcattatggcactaatatggtgaatggaataaatgtactctaagttatctttctggataagcagaaatctattcctttccttttcattctgcatgggatttcttctctgctcagatgtgaacagagatccaaggtggggaacctgggtcttgggccatcactttctgatgtagcctctgctgcagcacaaagggtcacatagtggtgtcttccatcacagcaagccaggaacagaccttgtttgggcagcaacagcaatggtccagggaggggctcagtccaggtgtaggccagcattcactaggctgtggacttagtggcagcagcacctcccatccagccaacaaatgcattcctgtacataactctgtcattgaatttaccacattatacattaattactatttctgttgattcaacaggaactgcatagtccctgactgtcaggaacaacagagccctgcccctctcaggggccagagagaggcatggtcataactgccccagggttgagtccttttcatgatgtatgctaaattctggtgcctcctgcttgctttctgtcctcacagcatcacaatgaggacaaaagcccaagggagaaagattggtgactgtggcagtgagaatccatgggtcaactgtgaggtaaatgttcttaagatccattctcgagaggctttagaaagctacgtggtctctgtatatgtaatttcaagatagatgtgtttgattatttttatttgttttcaccacaatgagtggaaaagaacatttttatagcactaatatgctaaatcctgttaaaaaaacacccatttatttgttccttcagtagatgttattgtgtgcccgacatgtttgtgtaatcccctgtacttgaaggtcagtaatagagcttaaattatatgtatctggggtcagctttatgcggctttttattttatgccaagaagtttggactttattctataagactgtggagcaaagaacacaactgaatgcaacacaactttgtgtcatgtagatgattctggcagcagtgctgaggacggggtgaagggagaagtgttgggagccaagatcaggtaagaggctgtagttttctttcagggagaagagactaaaatctaaaccggacaatgatcctgggaaaagagaagagggaatggatttgagagcttttctggaggtcaacttgagaggttgaacaacagatcagatatgaaccctgcaggaaagtgttttagcttgagtgagcagaagattgacagtgcataaactgatttttgaaacaggaatggggcggggctgagtgatgacaacaagtacatattaattagaaaatagttgtaggcttcttagttgaatacaggcagtataaatgagagtgtcagtttaggaataagatcagggttagagataaaagaaaatgtgggaaattgctggtgtatagtcaaaactgtgagagagaattaaatcaatcaagaccaccaaaacaaaaagagagaacgctgaggacagagtcctagggacaccaacattttagaggcaaaataaaatgagtcggcaaaggagattgagaaagtctgatgagtggagaatcggttgagacagatagagtggacgttctaagtgaagagagttcaataaggcaggccggtatcagagttgagaaggaagggacccttagtatgttggtgtctgtttagctcaaagaagaacgatcttataagttaatttattttaatttattgcatgcttagctcagactcacaggatttctttctttttcaaaaaaaaaatgtctttgtgtaacttttttcatcagaatgttaggtggtctaaaagttaatgtattagatatttgaaatattttcctttggtaattcaaaatattgcttggatgtaagttttatgtctggtgtagctaaccacaagctgagtggggcatcccttgcacttgtatctgacgtttgacttggtatccttgacctaaggcaatgtgaaaaagtaataccctttattacagttttactaacacacagagaaaacttccgacacacaccctggattggaaaagtgaggaagacattattaatcatcgctgggcagttctcctgccattcttactaccatttgcaattgtcttaaggctcagtaaatggcaactggcaacaacttcattctgcatcctttttctgaggaaagactgcaaagtggaagaatgaaggaagtctgagggggtggcatttaaaatatggttgaagcagtttgggaagtgttcttgctgctgtttagatatctgatggcccaacgaagtggaagcaagcacgcccacaaaaacactcatctcatgcagaccctccctgaatctcataaggactgacagctttgacaccattaccttctctttctttcaatggggccatgcactgaaatgccagattcgtggaccatgctagagcagagagttcactataatcaaaataaaggcctgaacatttaaaatatcacaaaggtgctaatttttctcagggcattgaggactgctggctccccgtttacccaggcactcactggcaatggtcactgatgagcttgagattgtaaagcagattttctgacacactaaattctgtttccaaaatggcatgggttgtgctaagaaactgagaggatttttgctttctttgtaatcagcagaagctcagaattatgaggttcactcactggataaaggactgcacttttcacggatggcagtagttggaaccttaaataaatattacccacggagagaaagagataagggcaatatggacaatgtcattcttgggctgatttctaaaatgaaaattcactcttctttttatttttaaaagttaagacagcattgcatgttataattccagcagtgatcttatcatgaagagacatggttgaatttccacgttgtctcaatagctggtttactgccttaatgttactttcttttaaaattgtatttttttcaagttttgaatatctgcactgtaaaatataatcacaaaattgttgaaaattcaacaatttatggctaggtagaagggaatgagttgaaagctactaatagtagtgtaattcaatcccattatcaccacacatcttgcaaacatatcactttatcctaatatgtgtccattgtcattctttctaacagctgcatttagactagtttcattgccagctacaaattacaagtgcaagtagagtttggggtagtataccaggaaaatgacaaagagtaaatctgctgaggagtctggatgttatcaataaatgtgagaactttgagtgagttttgtagcttattagatttctagaaaggtaactgggccaccaggcagatttactggtccatttcattgttggtagtgttttaccttaaaatctaatttttaatttaatgaattagacattgcatctttaaactgaagttttataaagttggagatcactcttgctgaacagaattcagtgctgcaataaatttggctataacccaatcaagtcttaactcaacctcttcctattccaaagacaccacctccttccctgattttgctggttcacccacagagaacatctcagttttctggaaacatcccaggctctgctttacctcagtgtcaccatacatagtgttctatgtgttttgaaggcattccttctttcctctgctaattctggcctatccatcaaggatctccatgacttcttagcaccactgtgcctctttattattacacttgcctcatcattttatgtaactgttcattgccccatccctaataggcagcaagctctttgacagctaaaatcctttctttttcatcttcatatccctattgcctagctgaatgggtagcccatcctctcaataaatatttattgagaatgaatgaatacatgaggaaatgatgaaggtatattgttagttaatgtgagtcctgttgcccttttcagtccataaaagacttgtggtaaaagttatcagcgtataggtctcttactagcctagaattagtagaatattatcagtaggagataacgacatctgaataggctgctactaatagaaaaataaaccatattttattgtgagcaaaacaaaatttttgcaaagcttgagatgctgaggaataactgtgtgtagggctgtattaatcagaggggtagttagcttccaggactacaaactattggttcaacttttgctctgccacttagcacctgtgtatccttaacctccctggtaattatagcttccacctattcatattttatatattctagcaaaatggcaggcgtgctaagtgttcaatgaatgctagctattattattccatttatcataggacaatcatctatttgtttaatttgaaattttaaaattaatcacacattagtctaagtatatatagatcttggctcactgcaagccctgcctcctgggttcatgccattctcctgcctcagcctcccaagtagctgggactacaggtgcccgccaccacacctggctaatttttttttttttttgtatttttagtagagatggggtttcaccatgttagccaggatggtctcgatctcctgacctcgtgatctgcccgcctcggcctcccaaagtgctgggattagaggcgtgagccaccacgcccagctgtctaagtcttaaagtgcaatcatagccattaaatgaaaatatatattctcaatttttaaaaattgtctatagccttacattatagacatgtgctaacctcagttatctgttatatcttatataggaacatgtctcagaatgaacggaaactctaagggtctctgaaggtctttgcagtcttaaacttctctatgccttgtttttaatatctgggtaaccaagattttttaaaaataaaattccactatagataggttttaaggagtaacatttttaaatgatgacaaaacagcatatttaaaagagttgtgtttgcattttattttaattgtgttcttcattcctaacaagtatcaatgaggaaatcaataaccaagtacttaatatactgtgtttaatataactcgtaagagttgtctgaaactaaactttcttgacatgcaaacttaagttctaatatcatccctttatgaatattatcctgtgcatttggtggatacgtggagcagtgaccttcaccaaggtgtgctgacaagactaggtcacgacaccaaaggtctggcttccagttcaacttcactgttttcttatgtgtgattctagataaatttaaggtatctgagcttcagctttttcttttataaataagcccttattcaattttcttagggttttaactatcagatgctaaataaattaaaatatggaaaatactacagtaaaggtaatttatttacattaaaagtagtaatcataactatgatagtctttctggtgtgtcaacttggcactgtacatttcatccatattcaaatactaatctagcagtttctgtagaggttttctgtagatgcgattaaagttcataaccagttgactttaatgtggccaagcctgattcaatcagttggagggctgtacagtttggctgagacttccctgaaagaagaaattccatttgtgcccatgcccatgggtcctaacctgcccttcttgatggcctgccttacgaagttcagacggtttagctggccctgcaattgtataaacaaatcacatgcaataaatctcttaatatatatgtcctggttctgctttttggttcatacagtagcaatttacatggctaccttctttgtgaagaaggaatgttagaaaatatagacactaataagagatgaagcaatcacattatggaactcaaggactctggttaatagaaatcttcctcagaaagtctggtagagaggaaagctatgggaaatagtaagtcctcattcagaaatgcaggaatatatgtttacttacaagaaaacagaaattcatgaatgtttatgtgtgtctcataaagtgtaagattgattcatgggtaccaaatgatggcccagcccatcacgatgccatcccagtgctggcatcatggaaaaggcagcatgtcccttcatacaggaaagaataagggctttgaaataaaacagacgtagaatcattactggttgcctgaagttggacaggttatttaaccttgctgaagctccattacattaactttaatgtaaatatgaaataataatagttctccaaattcatgtatagtgccagcaccaaacaaacactcgataagtagtacctaatgttcccttgaaacatggattctccacaccaggcccttgctcattttctgatcatcttagtaagaaccaatactgattgacaagcatcttcagtagtggtaaatgtttactgtttatgagcattcacatatttcctacctattgtgtcatatggaaggagaaatagtaaatacccagaaaaactatcacatcaaacttcccaagttgtgtagaaatatgtattataaatctcagtgtgcttcttcctaagaagtggacctctaatcacctccactgacaatgtgtggttttctctacatcattattagacacatcaaattacagatacactacaaatagatcctataggccagtggtcagatagtgttctggcctttatctccatgttgtctccattgttattttgcctagattacttgttgattcctacctattcataagttagatgtattagaagtaactgagtgtcagagcttcccttgccctctcaaactagcccccacatgtgaatggtcttttgaaagactttgctatcctttccttctagacttttctcctttcattatttcttaatagaggcaaacacaaatagtgacctctgaggggttaatgacaaagccagagattagcaattcactgtagcctgaataaaattttaaaagcgttacaaattatgtaaatagatgcggaaaagaaggtgtcctgctgtgggagggtgaagatgatggaaataattccagcttggacattaagtcttaattaagtagctgtaggaaataaaagtctaggttaaagagaattactcagtattgtcagcctatctatccttcatgagtaagggagagtattgagaatggggaaaggaggactgagaatggaaccccggggaatatcaagctgtgagaagaaaaagagaagcccataaagacaccaaaagaagagatgaaaaaatgtgactgttttaaagagggtgtggtcagtaatgtccgttgttcctgagaggataagtcaagaaaaatgggaactaaaattatccatcacatttatcaattgaggaatcaccaataaccttactgagaacagtttccttagagttgtgagtatagaagctggaatgcaatcccttgagacaaaaatgacaggtgaagtggggacatagcaaattgtagaaaacgttttcaagaaatttagttaagaaggaaagaatgaagaaagagccgggtcagggattttagtagagcttagtgatccacgattgtgttcaatgggaaatatggcacagtttcttttctccacaagtgtagagtgcagtatttatttactaggtataatgttggaatttgggaacacttggtcttggtagtacacctgaattatctgtgaaactttgtaaatatagatgcccaagccccacctcaattctactgaaccaacatttctggggtgcagtgagtcttctttggtcctaattttcttcttatcttactggatactatatctgttgcctatgtcctaccttattgaattgttttcttctttatgtcagcactgacatactaaatgcgaggtggtacccaactctgtctgcaattgctaaaataatggtctgaacacatatctttcaactattattctattatagtagttaattcaaatgttcttacttgttacttcgcaaattgtggaaatgtcagcaatacaattttctaccaattttgaaattacgctttttttgcagcttcatgtgaataacagaaaaacactatcagcagtttaattgatagcagtttgtcttttttaaactttcattttaagttcagtaatgagattgctcggtccagtggtagttctgttttcagctctttgaagaattgtcacatttctttccacaatggttgaaccaatttacactcccaccaacagtatgtaagtgttcccttttctctgcaatttgtttgagttccttatagatgctgaatcttagacctttgtcagatgcgtagtttgtaaaaatcttctcccattctgcaagttgtctgtgatggtttcttaagtatttttaacttaattaaacttaaactcttaagttgaattagatcccatttgttaatgcttgcttttgttgggattgcttctagtgtctttgtcatgaagtctttgctagttcctatgtcagaatggtattgcctaggttatcttccagggtttttatagtttttggttttacatttaagtcttttatctaccttgaggaaggggttcaatttcaatcttctgcacatggctagccagttatcccagaaccatttattgaatagggactcctttcctcattgcttgtttttgtcacctttgtcaaaaatcagatggttctaggtgtttggccttatatttgggctctctattctgctccacttgtctatgtgtctgtttttataccagtaccatgttgttttggttactatagccctgtaatataatttgaagtcaattaatgtgatgcctccagctttgttctttttggttagaattgccttggttattcagactttcttttggttccatatgaatttttaaaatttttttctagttctgtgaagaatgtcatcagtaatttgatagaatagcattgaatctgtaaatggctttgagcagtatggccattttagtgatattgattcttcctatccatgagcatggaatgttttttcatttgtttgtgtcatctccatctctgagttctttgatcagtgttttgtaattctcaatgttgagatcttttgcctctgttgttagctgtactcctaggtattttattctgtttgtggcagttgtgaattggattgatttctgatttggctcttggcttgtctgttggtgtataggaatgctagtgatttttgaacattgattttgtatcctgacactttgctgaagttgttttttagatgaaggagcttttgggtcgagactctagggttttctgaatagaatcatattgtctgccaacaggataatttgacttcctcttttcccattttcctatgccctttatttctttctcttgcctgattgctctggccacgacttccaatactatgttgaataggagtgattagaaaggacatctttgtcttgtgctggttttcaagggaaatgtttctagctttttccaattcattatgatgcttgctgtgggtttgtcatagatggctattattttgtggtatgttccttcaataactcgtttattgagaatttttaacatgaaatgatgttgaattttatggaaagccttttctgtatctattgagataatcatgtggtttttgtctttagttctgtttacgtgatgaatcacatttactgatttgcatatgttgaaccaaccttgcatcccagggacaaagcctacttgatcatggtggattatctttttgatgtgctgctggatttggtctgcaaatattttgaggatttttgcatcaatgttcatcaagaatattgccctgaagttttctttatttgttgtgtctctgccaggttttggtttcgggatgatgctggcctcacagaatgagttgaggaggagtcactctcctcaatattttggaatagtttcagtaggaatgctaccagcttttccttgtacatctggtagaacttggctgtgagtttctctgggcctgggctttttttgattggtgtttgttactgattcaattttggagctcattcttggttcagggaatcaatttcgttctggttcagtcttaggagggtgttatgtgtccaggaatttatccacttcttcttggttttctagtttgtaagcctagaagtgttcatagtagtctctgatggttctttgtatttttatagggtcagtggtaatgtcccctttgtgatttctaattgtatttatttggatcttctctcttttctttttattagtctagctagcaccctatcaatcttattagctttttcaaaaaaatgactcctggatttgctgatcttttgaatttttttatggtagcaatttgggagggaaagaacaatgtctgttttaaaggttacttggaaatcactccctccattatcagaggccctttattgcatggttatttcctgtctcttactatccatcttcatatctagctgcagcagctgtagttcacactctttgcttgccatactgcagttttgctataactatgtcatgaccaatttcatgtagtttatatgaattctgataaaatagtttttgaattaaaaattaaaaatagatttaaatgaggaattgaaagtactagaataagagtattgataaatagtcagaaaaaatggtcaatatgccagtaaaaggaaagacaatctatagacaacagctagaaataaattgataaatgagtgcagaatatgaataaagtgtttaaaatgccatcatgtttgagaattacacaattttgcacacatctcttcagtgccaaattggctttttatcaagaaattttttttggttaaagtgttatgaagaatacaaaagtagacctgctgtctgctcttggggaacaatgagacagagagtatatatatatatattatataaatataatataaaatttatgttcttatgggaacagaggattcaaaaataaagatgtttaataaataaaacagaataaacctagagtatagatagttgattgaaaagcatagatttttaaactatcatttactgacttatctcagtctgtgctaagccatttatccacattacctaatttaatatttcaacaactttctgaactgagtcctaacttttggataggagaactgatattcacaggggttaggtaactttcccaaagtcagatagctaacaagttaattcatgagttgacctccaagctctttctttcccactggaaagctcttcagtgatggagccccagctatgctgactccaggccagtgcttatgccacagcacagtcacaccacaatttgtccccactgaattggtctaagcaaggaattttgactacagtaaatgtgcactgagttttggggcacattttgtgtgtagttgtaatttgtggttagatacttttattaagatcatcatgccctattaatttaacatcttttaatgatgtgcatcatggcctattaatttaacagtctttaataatgtgcttactgtttataatatctaagcataaaaggaaaggcagaaaattgtaaatgcacacaagaagaaataagctatcttaaactacattattaatgaggtcccttttatattgccttccaatcagcatgaaaaactgatggagccaagattcttactgtggcttatggggaaaagttgcatgcttttataactcccatgagtttctagtctccacctttagtcttatctaaatgatgttaaaagtgctgggtatccaggctcatccagtgtgttcttcctggattatcagagactgagagagcacctatgaaaggaacagtaccataggaaaagcaattccatggatctccatcttccttattgattctggttaacacataaaactgcttcaagaagttcaatatgaagtcatcctagtgtcatttgttcaaagcctaggcttatcatccatttatttatttattcatgcatgcatttattcaacagagttcatgattgagataatataaagagtagatttcaatggtgtcagggaatatgggaaaggttctgaaaggctatgaagacccgctttcaaaaaaatggagctaaaacgtgttgtataacatgattagcgtagattagactaactttagctcctctttctggtagcagaggtttcatttcttctgtattgtttgtgtgattagtttcttagcaggaatttttaatttccgtacgtggcctccaattttcctgcctccttactggtgcagtgattccctagtgtcttaataactacagcggctatgctttgcttaatgagtgtgagctttagagaataatgtcatttatgaactcttaatgagtgttcacaattaagaaggcactgaagttcaagttctttttttttaaaaaagacattttcctaatgatacagctgctattgaaagagttgataatctggaaaagacgttgtttcttctgttttacagctaaagattttctcttagcttgacaaatttaaaaagtatttgatatatattttaattgctattagaaaaaatcaaaatgcacaatttaatggtttttagttataaaaatacagaatttaagggaaagagaatggaaattatagaaaatgaaataaacataggatgtctgtctcagttgtagacttgaaaatagtagtagaagataggatatatactgtcttatcagtagaaacaatgatacttgaagcaatgtcctgtggaacatgatgtatgtggacggtgatttctaagtataacctatttttttttttatcaagcccatagcagaagtcttagaggcgtttatagcattgaaaacagtttaatttagaataaactgtttctaagtaagaggacaatggcctgcttattcccttcctacctacaagtttttacttggttccaggtgtattttcaatggagacacaccagagaattttattctatgtcagaggaggccaattacagttaagaaaagaccctaagtgtctaggagtgatccaaaacatccctgatccaaagtatgctgagtgccaaatttgaacctgacactgaagctcaggagtcctgcactgtgcagttggtaccttgactctgaggcccttgaagtcactctctgggttctaagccacagggaattaagtttataaatttctgcagcctgagtttccagcattgccaggttgggtttataagctacaaaaatcttaggattaacgttagtaagcctgatggcacctacctctgaagtgattgagtggttaggggaaaggtggctaaccttcatggattcaaaccctctcttgctgcttagtttctttctttctttttttacaaagatgtcatatgtgctcatgtgtttacaaatgtacattgattatgtttgtagatcaccatcacatcacaggtgaggaagacggtaatcgtcaaacctttgggttggatgaactgaaaataatatttagcccagattggtatataatgtatcgtaaaatgagatccctggttgttttgtcaaacaaagtggcatgaagatagtggactgtgacacttgttgagcagggaagaattggtctgaagaatgctttattgtttataatacttagtttctggtttattttattcaatgcaattgctcttctcctcagaccccctattgaaatttaaggttttaaatttgattattaagactacctcttagccactttctcttcatctcattccctacctttcagctccaccctctctgacacattcagcaccatattgcttcaccttagttgtattaccctgtataactgcctcctcagttctcacactctaccaccaaatgcacgcatgttttcggcctctgcttggatgataactactataatctcattggctaaagcaaattgctttgccaagttcaaagtcaatgaatggtaaggaacattctgcctttttagggaagacctgaaaagttgcatggcagaggtactgaatacatgctgaatacagatttgggaccaagaatccaatcaaccaagtgaggatgtatgtctttttttttttttccattcagcctgtattgctatatagtaggacttgggaagcaagtccatcagataagcaagacagcagctcagaccccgtcaatctcacaatgtaatggggaggactgacatgaagcaaccaaatcacaagcatgataattactgtgataagatctttgccatacaatattcctttttgttccgagatatccttcccccttaaaaccatttatttatatctgataagagtatcaagactgactcaaaggtcaccttctgtgtaagttgattccagctataatcctttctagtccatattctctcatttttatcaattcagattctttgatgctgtgaggagtttccttgttgatacagagttcgatagtagttgtcagattgtgccatgtgattggtctacacataactcagatggaggtaatagcggaagaggactaggcgtaaactgctgtgaatgtgaaaaggtacttcctgcccatgctaaggccttggtaaaagctagctgcaagtgtcacactctggagatagtaactgtactttctgttctttttgctgcctttctaggatggaatgccgttgaatgattcccaaaaccaacttcgcagtactcatggtatctgaaatgtattagagaggtctttcactgaaggtctggagatagtaactgtattttctgttctttttgatgcctatctaggagggaattccactgaatgattcccaaaaccaactttgcaatactcatggtatctcaaatttattagagaagtatttcaccgaaggtctccaaacaaagttaaattttatttgtgtcaatttagaggaaaattatgtttcatgtggcaccatggaagggaaataaagaggcaaaggaaacagcatcatatctcctaagggttgaaagtcattgtaaataggtgctttaattaaggttagttagtgacaagattaggacttatatatccccttttatttattaacagtttaggcagcatatattttaaggatttggccatcccactaataaaaccttgaaaccagagattaaaaaagtactgcaaaagaaagctgtgatcaggtttgtttgtttgtttctttctttctttctttccttctttccttcttctctctttctttttttttctttttgtgtccttgtcacaacaacaattttttagttcaccaattatgctttctttttattatgtctggtcatggttgaagcaacttataatgaaataactgattgtttattttaagaggaagatcagacctagcattttaaggttgacatcaactacagtgaacctcttcactgaaatgggtctgagcatgagtaccgcttgtcactgggcaagattgcagggggtcctattcgcagaatgccagagacttctatcatcctcaacccgtctattttgcattccagcaacctgagacccagagaagttaaatatgctgtttcagtgccagaatgagctagtggcagagcctggatttatttgaacccaaatattctgtctataaccagtgttccttgaatcttgtcagctttcttcaagatttcttttggcagttggaagttttagataatgacaccatgtcttccattaccaaggaaaaacactcaatgggtttaagtactaagaaaaatatagaactttataatttaaggaaagaaataagaaggaagaaaggaaagaaagaaagaaagaaagaaagaaagaaagaaagaaagaaagaaagaaagaaagaaagaagaaaagaaagaaagaaagaaggaaagaaagaaagagtgagggagggagggagggaggacaattagatgtgacctctgtggtagtacataatgtgtgggccgactgaaaagagccactcagcaatggggaagaatttcatcaaggagacaacacattaatgggaccttgaaacataggctgtatttgacacctttgtggagggcaatgggtttgggcaggaagggacaaggatactgccgggaccaagagggaggttgtcatggagaaccagagaaggcagaagcctcaaaggcaccaagaggggaatgattccaaagcttttgttgctcttattttgttcctcctatggagtcaaactatattctcttgccactctctatgtctatgtgatgatcctggcccaatgttcacctagagagctgcagggatgatgcacgccatcataacggggattgctaggccaaatgttcttgccaacatttcagtttctcaaaagaaaaaaattgagaaaatatccattattctttgttatgctaattatattcacataaacatattcttatacatgttcctttttttctagttattccatttatgctatttatttccactggatagagctgtgaattttggaaaagcaaagatcatttataatgtaaccatattatgtctaaatctcctaatattatttggtgaatacaatatgaaattatattgaatatatgaaaacatgggagataaaggaagaaatcacaccctcactatccatgagtagctactgggggccccatactcactgccaccctcatgaccttattaaatcctctaaggtctgtctcctctcttttttaaaataatcacttttctaggaacagaataatctaggatgtaacattgatttcgttccttttgggctttttcttcagggctggtattcttctgctatgtttcatttgctttctcaattcctcctgagttacaaggctttctattttctcatgtctttctggtcatctcatttctgtttgcagctgattccaaagctgttgttgctcttgttgttcctcctatggagtcaaagtatattctactctctccatcctctgtgtctaggcattacgagaaatgtgcattaccactgttgtgtattctgtatgacataggcttgaccaaacagcctgcaatcttcacaattattcttcctatggtaccctaaatgtttgcttagtgattactcaacttaaaagctgaaatccatttttgtagcaaacataagccactgggcttacatttcctgtgtataagtattcaaatcagtgctactatatgcatgcaaaataaaatcataagcttcagtgaccatcctgggtatttactaacaatatacctatgctaagtgatgagtcatgcctgggataccacatttttctcagtgaatgcattttaaataccaacagaacctagatggagattatgtttaagcaaaaaaagatttaaagtgtttccaattttctaggtgtgccagagagctgcccaccatgtggcaactcatgctgtcatagcagatggtcatcaaaggggtagcttagcacttatgactcatcccttgcactgttgctatataatttgccaagacaatgaagaaaagtctctttctcataaattcattcctccctctctactgcgttcttgtactcaatcaagccctcctattgacatatatatgtatatattttattctccttgccctttcatcttctgttctatctctagtcttccagtcattgctaaatgtcatgaagaatagacttcacatcttcactactccttaccactcaactccactatcttgtttctgcttctaacagtacctactaattgacatgatgctgctctttcagagtccctagtgaatatcctattgcaaaatctagcggcccctttcccagccctcacactcatgtaattttccagagttaaccattcattccttcccctacttaatttctatgacacttctctttttatctcttcttcttctccttcctcctttccttctccttctccttcttcttctcagtatctacttccgaccttctttttcttaacttgcactttaaatgtagaattcttggtattctctgtccctatgtgttctccctgtatgatctcagacacttctccagccattatctaccctcagatgatttgaaatttgtattgtatataccagttattttcctaggctccacatttacatatgtagcagcttgatgggcacagatgttcctctggacttccaaattcaatgtgttcgaagtgcaattggactgtgaggaagtaacacaagagcatggcctttgtcttcagatggaccagggttagatctctggctcttagttgctacaggaccttggaaaacatgcttgaacttcttgtgcagctgtaaaatgaaaactgcaaaacaggtccccaacccctgggccacagactggtactggtttggtccatgacgtgttgggaacctggctgcacagcaggaggtgagtggtgggctagcattatcacctggagctcagcctcctgtcacatcagaagtggcactggattcttatcgggggaacccactcccaatatttcaacataggttctttctattttccctaagtgttggtcagtctgagaaataaagagaaagaccacaaagagaggaattttataattgggccaccaggggtgacatcacatatcggtaggtccgtgatgcccacctgagccgcaaaaccagcaagtttttattagggatttcaaaagaggagggggtgtatgaacagggagtaggtcacatgcttcaaggggcaaaaggcagagcaaagatcacatgcttctgaggaaataggaccaaggcaaaatcagaaactcctgataagggtctatgttcagcggtgcacatattgtcttgataaacatcttaacagaaaacagggttcgagagcagagaactggtctgacctcagatttaccagggctggggtttcccaatcctggtaagcctgagggtactgcaggagaccagggcgtatctcagtccttatctcaaccgcataggacagacactcccagagcagccgtctatggaccttcccccaggaatgcaattcttttcctagggtcttaatattatattccctggtaggaaaagaatttagtgatatctcttctacttgcatgtccatttataggctctctgcaagaagaaaaatatggcttttttagcccaaccccgcaggcagtcagaccttatggttgtcttcccttgctccctaaaatcgctgttattctgttcattttcaaggtgcactgatttcatactgttcaaacacacgttttacaatcaatttgtacagttaacataatcatcacagggtcctgaggtgatgtacctcctcagtttacgaagataacaggattgagattaaagtaagacagatgcaagaaattataagagtattattagggaagtgataaatatctatgaaatcttcacaatttatattcctctgccacggcgccagccggtccctccatccggggtccctgacttcccacaacagattctcataggagtgtgaactgtattgtgaactgcacatgcaagggatctgggttgcatgctccttatgagaatctaatgcttattgaatctgaggtggaacagtttcatcctgaaactgtccccccaccaccagtctgtggaaaaattgtcttccacaaaaccagtccgtagtggttggggaccactgctataaaacctactttgcagaataactatgaatataaaatatctgaaacaaaacctagcaaattgctgtcccttaatgcatatgagatattctctatactacattctctccaatgactcttccacctattgcattcctattcctttaatcatatcatcatcccataatcatttcctcttccttctatcccaatcctcacatctaatcactggtcatgtcatgtagattctgtttctctagattccatagagtccacccttagctgtctatattttgctccttatttgttcctggattgttgcaataacaatcaaattgatttctctgttttccataaatggaaaatcaaaccatccattatttcattatcagagtttttctgttttcattttcaggaaacacagcaatactcaggttattcttcttaaaacccttcagtagctctgtgttgcctatagcacgatgctataattcctttagctgtcaatctcccttacagtgttataattactgtctttccagagtgttccctcactacttctctttctgctctagtaacaccagagttctcaatgtccctcaaacaagctatccaggttaatgactttctttcagttttgaatgctcttcttccctgataaaatgccagttactttagccaggtcttcctttttgttcctataacacttacttgaatctctgttttcattctgcatttattgtagttaataagcattttctccccacaagctaagtcctttgaaatcagactagataaaggcaataaaggtagtaagaaagaaattcaaatgctaaaggaagaaccaagaaatgtaattatgcgaacaataaggtcaatacagcaataagggcaattactgtggctatgcacaaaactttgctgtgaaacatttatcagttaagatttggttattaattcattcacttcacaaataattttggggtgaattccttgtgtttagccctaggtattgaaaagcaactaacaagactgttctggctcctactcagaaaaaaattatgggaaaatgttatatacttcaaacaaccttagaggaatatatacaacagttcattatgaaaagcaaaatttctcctggtactaaagtttgagaaaactttctcattaggaacataatgtaggggatattgagtgaaataatgtataaggttctcaataatagtcttataataaatatagaagcatggttttatatgactgttaaggtataacattgaaaatcatttctatcccctgctctacagaatgcctttacatactggggacttgctaaatagttgttgaaatcaagcactatgatctgactttgttgatcttttttcaaatactgatagatccatatccagtagtatcattggtatcttaatcaaaatggctttgtgaatttatttatttggcaccaaagaatctttgtctgatggcctatatgtattagtttcccattgctgctacaacaaattaccacacaacaggtggcttaaaataaccaaagttatcttataattctgtagtttagaagtcccatatagttctcagtgggctaaaatcaagactctggcagggctggattcttttatggtgactcaaaggcagaatctgtttcccttctttttttagcctcaagaggcaacccatattccttgacatatggcactcttcctccatcttttaagccaatagtgttgcatcactctgatcattactacatactcacattttcctctaactgcagctgaaaaagattctctgctttaaaggactcatgtgattatattggacacttctggataaatcaggataacctccccataacaagatccttagcttaatcacatctgcaaagtcttttgtcatataatatatttacaggtttcagggatccatatgagaatattggggggggggacattatttcacctgccatatatcttactgtcatgttctaatttataatagagactacgaattccaaagtgccatttcaaagaagcaaattgcaggatgtaattctacacccctcccgtaaaacaacagcaacaaagattacatttccttagaatgcatgggtacttgctatttgtgcatgtgcaacttaggacatgtgcatttttattttttctgctttttcttttttctttctttcttttttttttttttttgagacagagtctcattctgtcacccaggctggagtgcagtggtgtgatctcagctctctgcaacctctgcctctcgggttcaagctattcttttgcctcagcctcccgagtagctgggactacaggcacataccactacgccctgctgagttttgtatttttagtagagacagggtttcaccatattggccaggctggtctcgaactcctgacctcatgatctgctcacctcagcctcccagagtgctgggattacaggcatgagccaccatacccagccttttactgcttttgtaaggttagactttggaattaaaagagggtgtctgaggtgaccatgtcagaatttgctcctttacagagaacattggagatccctcttcccctctctctttctaatgttatgcatttctcgacacctgatgtagaattgataatgggttaaaagcatcttttccatttctttgactagagcaaaatgaagccataaaaatatctaccaaccctgggaagctcttgcataaatgactggtgtttattgctaatgtaaaatgtttttgattgtgaacatgctgctgtgtgatcttctgaataaagataattttatactgtatgaataatttccctttgttttccaaagtgtttgagtggttagaaaaaatatttttattatatgtctgtcagtttcactatacaaaattgaaacaatcttggaagttatgagtacaaccagatggatgaagatttccgattccagtctggaatgtgaacaaagcgtaaatgctgtttgtggattatgagttatttactaggacttatcttagaacaacgtaatcagtacctcagcaactatctagttctgcacacagcaggcactcattaaatgtttattatttgaataagagaatcattttatttgtcttcccatcaatagttgttcaattctattcttcccagtcagtgcctcatactacaattgttcatcctgtacctaaaattaatacacattcccaaatttgttacattgttttggagaatgcatgactcagcctttttgccaaatgctatacctttccagaagccttataattatactttgttaattgcaaaccacaaagctgccatcatttctttctctctctctttgtaaaaaaaatggtatcccagaatagataaagaagccatgatttatatgactctcttttcctttctgttacaaacttgtttccctctcccacaataggaagaaattattaggcagattaaaagctttccttatggaatctgtaaaagaaatgatgcttgtactcggctcccgactgcaaaggccaccaacagagtaagggatggcagaaaggacacggaaaaagagatgcaggctgagattgaatccagtgatctttggagagattctgctggctcatgcaccagtgcttgaaagttctgtgttttagtttcacagtataaaaatgtgctgaaaaacatcttagtatattgtcttttaggctcatctgggacagatatccgtcaaaggtagtgattgggctttctaagggaaggtgatatgttattccttgcaggaaataattctttatatgtcccgttccctagatagctattgaaatttgtgtgccgggctgtggagaaagtagttctgtgaaaacctgggaagaatctgattagagagtggtgaaccctccctgcaaatgcagaggaagcacaaggaagaggaaggcaatcccttcacgtgatgaccccgaatcattccagtccaacccttcacaacagagggacatttttttgcttagttatggcaggttctccatttcaaacaatttgctttagacccattcttgcccctccccctccaccttggacatcactcttttagaccttcttgtcactttacagctcactcaagccaagtcacaaacattagttttcctttgctgcacatcacaaaagtcccattcaccctcaagttaggatgtggcttctgtgacaaccctcggagccacaagccaagcccctcattgtccggggaccagttagtcatgcctacttggtttacctacctggtttgttgggagagcttgataaaataatatgtttgacatgcatggccagctccaaagtgttcttcaaagacgacagaatcaatcttctgtaaagatgattagtccctcactgtcttcacctctcagccaggcttctgtgttcatgtgagttttattatggattttctttcagaatggtgataatttagcatgacatttttaatacatatttttaagttacaatttattgaagtgtaacataaatacagaaacatacaccaatttcaagtgtgtggtggaatgaattttcacgaagtcagggtacccatataacaaacatccagatgcacaactcatgctcctcgcaattcaacaggtttctaaaacagtgtcttttgggaatccagtgacttctctacgtagtcatctatggtttccccagtatgcatggctctgtatatctttagtgagaaggtcactttctctgcaaggtgtagcctacagcctttttacggaagcaaaaatacctacaacaagtgaaggacatttaaaggattgaactccaatgtgtgcaaaatcagcatgaactctacatgtgatgactaaggcattgatcatagagagtaggagataatcatgtggggtggggagggggtcccaagcaaagcattgtcagaagctgggaaaggtattatagagacatttcttcttcttatccctcacctcaccctatactttgcaccccagatcctgttttgctgtcttatattaactttgaccacccgccacacccttctatccaggaagagttccatccggcaagatatgcagccctagttcttttcctcctttatccactacctttgcttattgctgagcttcccctgtctgctcctttcctttactgtcaatggtgcatgtctccgacttaataaaaacagccttgggttttgtatttctaatctatgggctattaatgaaatgcggcagtggtttcattcttatctctaaccaccatgagcatccaagtgccaagtgtatattgtgatcactaaattgccatgagacacgggcccacaattccaggaatgtgccatttgccataaagctatatctgaaattgctattaactctttcctctgacttcggttcttctactaggaattttctttcttatcgtaactctcctaaatattatattatccatagttctctattactagcctcatttatattgagactttttagacatttcattaagtcactcactccatgaagaccgtttatggcaaagcacctattataggcaaagcattctattaggtgcagggaaataataataattagcatgtggatcttgcttttgaaaaaattaccaagggacataggacatgtgcataaatatgtatattttaagtgaccaaaaggattgacagataatggtatggatggctgagagatgagaagtgaggagtaattccttaggactgggtggatgaaagaaaacctcatgaaggaagtgacattttaagagggccttaaaagttgggttgattttggaatatatgatgatttggtaatcttggtggtggaatcagggtgaataagagaaaagtgaagaccaaattgagtttgtataaagaacagtgaatagttaggtattgtatctgttagaaatgcttgcaggtgaaaggaatatcaacatcaaaaacaataaacgctaccaaactagctcaaactgaaagggcattaagggtgtattttgaaagaatcctggaggtattttgtcccagactgaccaccaccttcattctttgttcagggccagctttgtcatcaagggctagccttctcctcttcttccactccatcattcttagcacatcggctcttgatgtcagcttaccatgacaactcacggcagtgcagaagcacatgtccatctctaggtcaatcgctgggaaggtgatgggtttgttacgattttctgggattaactgtattcagagcccttatgaaaatagggtttgttaacaaaaggaaagatgagaaagaagaggaagaggaggaagaggaaggaggaaggaagcagaatgtggaagtgaataagaatacaaagaaaagattgaggaggaggtggaagaggagtaaggagaaaatggcttaaaacttgagttttaggggcacagtgagatcattttggctacaaagtgggatcatattatgggtaaactggtaaatcccatggtcagcttttagtctttttccttgacctcttctttcacctgttggactctgttgactcaccttccccctctgtcctgctttttcctgtgtttacttcctaagctctggctgctccttttcaaggtcgtttgctggtgtctgccctctgtttcccacataaatggcagtgctcccaggtttctgtccaggtcctctcttctcagtcctcctaaggaaacccacataaactcaacaacttgatacacattgctctcaaacctccagcacaaatctttaactgctctttctgccttggatctgcctccccacaccctccccatgtagctcagcctctgtggcttccctcaagctttccccacaccctggaattccacacactttctttggtgttgtccaacaaatcacttctcattcaagaggaatttatttcaggttgcctctctgcagtctagttcctaccgccttccgcggggttccctgtgccctccctcacctcttcagtgcctctcttcatgctcacttcactgtacctagtcactgattcaaggaccagcaactctctaggtcactccaaaaccattgcagcctgcccgctgcaggccactctcagatgccacccagatccctggaatagtcttcttatccacctccttgtacccctccggctgttctccaaattgtgctttatgtggtagcaaaatgattttttctaaacaatagtggtgtgatgactatcctctgcccaaaatctttccaagggttcctgatattctcaggagaaagacaaaggccctgacatttcatacagagccgtacaaggggcctccctcttccaccttgatgtacatttgtctccctcttgctttctctaccacagttccaccagccttctttcatttactccaaagtggcatgccatctaccttcctccacaggatctttacaaatgcttttctttgcctggaatgtctatcttctccaccttcatcacactagctgctactcctctatctgattgcagctcaagaggtactgccttgggaaagcctttcttaacatttggatccctgacttcatggagccttgtctcactcattcattgtgtttgtcattatttatgaccgtggaattgtttttgtgattgtttgattaatatctgtttccctctctaaatagtcatctctgtaagagcagcagctggggctattttgctgatgtttttattcccactatcttgtatgatacttggcatgtcataggcacttaataaatatagtgcttttagcaaaatgaactttctcttttataccatgaaattctgggaaactgagacaagcctggtttaatgctatattctgaggaccttgaagagtttttatctatgaagattgctaaaattattgataaatgattgatttaagaaggcattgtggatatcaggctaattaatttgtgattattgatggaagactgtgtgtttgtaggtgtttattgccctaaccagctaatcccagataccctcacccagtatttctctataatgttcctaatccattctttctgccccagttttctcttttaaatggtcagtgagggcctggaaacatgttctcacctctgatcagaccaaggaagcagaacttctctaatatgtgaccatggtttccctggttttgagggatttgatgttctaagatgcctccgtcttgccaactttgtagtctgttctgtttcagtctgttatttattgtgttttttcaattctcccagctgcctctcttaatctcaaattccactattctacttgctaagtcctttcatctagaagtgacattggggaaggaggcacattgaacactttcatggacccaggtcctaaatggcaatgtgtacttagcagtgaacaaactgtgttagtactgaagctgctgccacaaagaaaactgtgtctttcacctgcagggtctatttatgtgaccacatgttgaagctcaggtaaatcttcagcatcctctcatcctgcctttcctttctgattaggaaatcttttatttatcatggttttcattttctctgaacagatggtgcattaccaacaagtgacaaatgactgtcctcccaacaagtatttagaaacaaataaaattaaccacaagaaatatggcagcagggtgagtaagaagctcacaaagtaaatgagtttatcacattatttgcttccctactggcatcatgagatccacttttgaaaaatatatataaaatagtcaaagaaactgatttagacagatcagttaacctcatatatatttcctccaaacacaattattgggaaaaataactaatcttttcttgtcaaagcatttgctttcctagaagacagcagagttctgtttagcctcatgtaaggaaatagtgtaatgcattgtgataaatagatgcctcacacctttctaggaaagaaaaatgttgaggcctttgactgcaactagatggactgaagctaaatgcaactatctccgtcagcaaaatagacccagttgctgctctctcagagattgcagtttagagggggaaatagatattaatcaaacaatcacaaaaacatggtcataaatataagcacaatgaatgagtgagaaaagctccatgaagtcatgaatttgaatgataagaaaggcctcctccaggaagtgattcttaagctgcaatcagatagatgagtaggcgttagtgtggtaaaggtagagaagatagacaaacattccaggcaaaggaaagaggatttgtggccaggcacagttgctcacacctgtaatctcagcactttgggaggctgaagtggacagatacttgagccaaggagtttgagattagcctggagaagatggagaaatcccatctctacaaaaaaagatacaaaaattagctaggtgtggtggcgcacacatgtagtcccagctattagggaggctgaggtgggagtatcgtttgaccccaagaggtcaaggctgcagttgccactgcactccagcctgggcaacagagtgaaacctgtctcaaaaaaaaaaaaaaaaaaaaaaaaaaaagcataaaagcatttgtaaagatccggtggaggaaggagatgacatggaacttaggagtagatgaaagaaggccagttgagttgtggcacagaaagcaagaaggagacaaatgtgcatcggtgtgaagagagaggccccttgtagggctcaatgtgaaatgttagggccttccaagagttcctgttattctttctcctaagactaacaggaatccttggacaggtgctttcagcagagaattcccagcttactctcattgtttgaaaaagctcattttgcaactaaaggcattatgtcttcaaagctgcattctatgacatccactcatgctcagcatcagagtatgcactcagacattctagatgtgagctatagatactcgttttttttaatgtttttagataatgccactaattctgattctctgaaatatttcaacctatgagatgtgctttaaaacatacatgctttggatgaaaatgccataaaatggaaatgtgatataccctataaatagatgaaattatatataagaacatcttaggaagagggtaaaattaaatcagtaactgaaacagtaattgtaaaatattgttatatttcctcacttttcacagatacttcactgataaaaaggggaacaaaatatgagattgttagtcacatgatttccttaccgtgaacaacagttacacacttaaatgtaggctgatagtagttcaatcagagtccacacttctttgagaagttcatgttctgcatgagttagtcatggcaaagtgaataaataattcatgtgttactactccccacccttcctagatggatgtagtgtaagggatgttaatacacctaaaagcaaaagatggatattctaacttcagggatgagtgtggagctaggcggcctgttccaccgatctctctttccttctctcctgaatcgtcaacattcaaagttgcagtggcatctcacatctttgaaaacaattccaccttgatctcactttcccttcagctttcaggtccttccaccccaaaagtatctataatgatatatgagtgatatgtgattaagtattgatataatcataatccttagtttgggaattaattttcattttctcccccagtcctccctgaccaccactcccttgtccctgtcctcttccaaaggctctaccatcataatcaagaatatctccttgactgtaatacatcatgacaatattgttttgtctgggtatgttttcacaaaaacaaaattatgctacattttaagaaaagaaaattgtgctaaagagtcattctgacttaatttttttctattcaacacttttaaaactattcaagtttctacatgtattgttttaaaatttattttttagttagcaaataaaaagtatatatatttattgtgtgcaacatgatgtgatatatatgtgtatattttaatgtatttgtgatgcctacttgcagttccatagcataaacctttcacattttctcctcctttcctaaattgcctctatctctcccatgccacaaacaacactgtggtgagtatcattatgcacaccctctatcttcttttcttaacttttattttaggttcaggggatacatgtgcagtctacatgggtaaactgtgtgtcactggagtttgttatacaacttcccttactcaaaagagagaaatgtgtttagtatatacatccaggagtggagctgttatatcctaggtgtgtgattaatcaattgcaccacggattgctttccagaaacgctacattaatttacactctcaacaagaatccactagggtttctgtttcccaacatctttctgacacttggtattatttgggctctctaatttttgccagtctgatggaagaaaacccttgttttaacttgcatttatttgattgctagtgaggctgaatatttgttcatatacttgttaatcatttggatttcactataaattatatatttaaattacttgcttatttttctattgtgtttcctgtcttcttgatttgggggtatttccttagatttttaagatattactccttgttgattgtaaatctttcccagtctgtgatctgtctgtcaactttgtctaaggtattctctgttgaacaaaaagccccatttttttttaagaaaggaagtaaagtacacttggaagagagccaagctggcaacttaggagattcaagtgctaaagatcccacatttagatgtatggtttgtgtatttagcagtctcaatgttttctatatattcttctattaaccttgtagttccacccttcacatttaagtttcccctctgtatggtatgaggtaaggattcaaggttgttgatttttctttaattggtagttttctcccaataccttctgctaaacagtctaccatttcaccattgattaatggtgccagcactatcatatattaagttaaccctgtcatgtagtattttctgagttctctgtgttacaccagcagcatgcatctatttattagcaggaccttaatatgtgtgttcatatatggtaaagcaaaatccttgcttttgttctttgtcaaaataaccttagtttgttttacttgtgtcactttcaagtaagttttccaaagttctcaaaattgttgtttggtattgtatcaaatttatatgtaaacttgaggaaaattaagatctttaaagtgtgaaataatcccacccatgaacaaaacttatctctcattttacttaaatatcttttaagacctttaacagagtttttaaaatgtgctctgtacaaattttatggattcttggctaagttattccctagaaatttactaattttgttgctgttgtaaatctacatcagtagtctgtagctttctttctgagattctccctgtagatacaccaaactgtcaatttgatattttcattttgaacatctctcattacctaaaacttcacatgtacccaaatgtgcatttgatctccaccccgcttccagaatgttcccccttcagtcttctacaattttaataatagctaccactttcagctccttccagacatccgattataaatcttttactgatttcctacctaaactattctctttttcaccatttcatttgacgcctcattaagttttactttaaagctaaagttctttataaaagcagtcttttcaaaattagcacataaatatttattgaataaattataattttttttctctgattgcagaggttggtggtgacttttaggtcatggcagcaatatttttcttgcataatcataaaatataatgctgttgacgcaagtactgtttttaaaataaacttgcccttaaaatgcagtgggtattaataagaatagtataaaatatgctgttataacaaatatcaccaaactctgaaagtttatttcttactaagcaaagtctgctgtgggtataggtaactctctagggcaattgttcttcatcccagttttggtagtgatacaagtgcatggaatcttcaccatcctgtaaaaacattatctggaactcagtcttgttcattgactttgaaggcaaagagaataccgtatgatttttcattggcaatgagaagctttagatcgaagtgacacatttcacttccactcatagaccattatctggaactgcacctaactacaaagaggcagggaagtttaatccccccaagaagaatgggatgtgggagggcaccagtagtttccaccccacaatgtgtatgatcaagaaaggaaaagcaaatctgctcacccataacacaaaatccttcacgtttccttccagcattagcatattgtgttgtggacattttgttctgtcaggaccatcgattttaagttcttctgagataatatggtctacagtttgttcagaatggttctagttctcaatgtttgctttttagaattttactagaaaggagaatgatcctggagaaactatatctatatctaactagagctatacctgtatctgtatctatatatatatatctatatcttccatttcaaatggcctgggaatcatatagaatgagctgccatgactatagtcatattcagccaaggaagttaattgtgagggaaatattggagactcatatgtaactcagcaccttaagatgctcatttgggccaggcacagtggctcacatctgtaatcccagtgctttggaaggccaaggtgggaggatcacttgaggtcaggagtttgaaccagcctggccaacattgtgaaacttcatctctactaaaaatacaaaaattagccaggcatggtggtttgcacctggaatcccagctacttgggaggctgaggcacgagaattgcttgaacccaagaggcagaggttgcagtgagctaagattgcgccactgcactccaggctgagcaaaattccatctcaaaaaacaaacaaacaaaaaaagatatccagttgattccatcaatcattgaatttatgtctgattttgggctatttagttaatctctctgtgtatccattttcacactgccaagtattaatagtaatagtgcctcctccttggggtgttggaatatcaaataggataatgcatgtgaaccgtttccgtggtccccatcacttagtaaatgctaaataatcaggagtattgagaatatatgatttcatcatgatttaaacatttggtcctaacttttggcatcaagtacattagggatcaaaagattttaaaaattgttttttcctaaaaacacataaaattgctttttaaaactatgatttttcaaagttaaaaggtgagacaaaaaaacgaaccttgaaatagtttgtctgtgtatttgaggtgttcacaaataatctcagctgttgctaagacagcataaggaaacaaattttttagtgacctggattctagctcagatttctgctaactagcttcaggatttagaagtggcgttaatgcctgggtcccagttttgttggttctactatgaagggatttactaggcaatctctcagagtcattttagcactcgaattctaatactgaatagctttcacaatgtgtgaagtggatatattttccctaagggtaaaataaatgctccaaaatatttcatgtagatctttgtaccaaatttatacatagtaaaaaataggacacaaaaaagaagttggagacacagttcctgccttcagtgagcttctaataccagtgattaaattcctgacagtgttagcatattaccaacagatgaagtaaccagagacttgtatttcaaaaggtcaaggaaaagatggaaggagggttgacttgataaaattctcatgatgattcattagaatctctgaaagcagaaatctcatgtcttctgttttcatccttctgggtgctaccctgtttatacaggccaaattcactttccatgactcttaaaatggtgctgtcattagtaaatgtcacatcagagaaaacttctggtttagtgcatattttactttcttagaagctcagaatctatgatcatatactcaatatgaatgcctacaatcacagggattacacgtatagcatcttcttttggtatcattaaaagacacctgaaggagattcaaagaagaaataaaaaatggcttttaacttaaagtgatagaattgaatgctgatcccaagaaattcagccttctgtgggcatctgcatgatcattctgcatgattgcttctcctggacaaagttggttctgacaagaggccttttctcaatactaatccatgagttaacatataaaaacatcattttcaaggtataacactgctcttatattcacagccagttgcattcaaaatagctttctaagttttcagattgccggggcatcttagctctctgaatgtagccttagagtacaagactcaagccatatctcacacatagttcagcacagccctgtgcagactggccagatcagaggccttcctggaccagccaggcctcctgaggactaggaatgtgtcctgatggactcgcaaaattcctttttcagtattttccttttttttgcagactttgcttcgtatctctcatacacaaaatctgaaacaaacaagacaatccaacaaacaaacaaacaaaaaccttaaaattaactttttttgtatacattagatgtatgtcacccaccttagatttgtagcaagctggagttctgggactatgtagatatccttaaaatcctcttccttgggctgcttctcagcatgaccctgtggtgcactatttaaaatcccacagttctgacttcgttcttttcctctttcaaccttttaatactgtgtcagatttatgatacttagggaagtataataaaagattttccaccgattaaaggattcttttcaggattttgatttagttacataacaaatagtaaaaacataaagtaaaattaatttttataatatattttatctaacccaaggtattccaaatattatcacttccataggtaatcaataaaaaaagattaataacataaattcttcttgtcatgttaagtgtttgaaatcctctgtattttaacctgaaacacatcttaaactgggtgctaaatttttatcggcagtacttgaacactacttatatgtcataagatttaatttgaaaaagcagattcacaagctcaagttgtttcaaacataattaaagtatttgaaacactgaaataactacaggtttaatatctaaattaaataaaatttgaagtttggtttctcagtcacactggcctcatttcgagtatacaggtggctagtggctcccatcttagacagccaaaggccttttattttactcagatttagtgagactgtactggaaaacaatatataggtctggacttaaaagctaagaagaaatagaagtaactttgagagacaagcgaaatgtcacaaaaattattttaaatacttctaaattttgggaaaatatgattcaccaggaagtagccgacttctgcttgtatggaaagagtgcatggcataagaatcgttagaggggcccttctccatctcagatgacagctagacacagataaatggatttcagctctaatgggagagattgtttagccgtaagaaaaaatttctctctattcagaatagaaagtcatgagaactgtgtccctggagcacattgaaattagggcaaatgtgcctctgtctgggatgatttagttgcaggccttcctgaaggatagcggatcgcaccaatcgtctctcaaggtctcttcctgctgtgacgctctgattctaggaaaacccatgggtagaaaggccacactgccagctgtttccaaatgtcgtttttgcaaggacaattaatctttctgattacatgactagtgctatagagttttcaaactttttttcttttcccttgtctgggaatgtgttgaaaactgagcaagcacttagctatgaatgctgggaagctgtgaattggtggaagagtcctttctatggctgtgttttcaatgggcagtaaatcccatgtgtatttcagaggggcagacacatgttcctcctatttaaatggttttcagaaaaatgctgagatcaaggacacattcacattcaggtaaatgtagagggtgggcccatggctcccactggcaaataatcttgaattgctttagttgctggtaatgtagctgaatcatggacaaaaagagcatcttggatctggacctggattgcagcatctggctctctacaatattgtttcccatttacttctgaagattcattaatgcagagaactgaggggctgtcaattcaagaaagaatgattctagaaactggcaaacatctctggctaatgtcatcaaatatcttttttcctggataagatttagttaagtttccccctaaattgttttatttcttagtcaagggaagtctgaattcttaaacgctataattgcttttaaaacgttaggaatgagggactagaagctatcattgtgttagttgagatttgccatgaattttctggaccagacagtggtggcaatgtcagctaaattgcctggctaccccagtcctctcacaaaggtgagagtgaacagtctgcaaagagcctaaaaaggcggcagtctaggattttctctgaggttagatctcatcatattcacatataaaacatgtattaaatatagtcatatactgcataatgacattttggtcaacggcaggccacatatacaaatgatggtcctataagattataatggagctgaaaaattcctatcgcctaatgatactgtagccatcatgacatcatggcacaacgcattactcatgtgtttgtggtgatgctggcataaacaaacctatgtacagccagttatatgaaagtatagctatacaattatgtacagcaaaaatacttgataatgatagtacatgactatgttgctagtttatttactatactatactttttatccctattttagagtgtacttctctaattattaaaaaaaaagtaagtgtaaaacagcctcaggcaggtccttcaggaggtacccagaacaaggccttgttttcataggagatgacagctccatgcgtgtcattgaccctgaagaccttccagtgggacaggatgtggagatggaagacagtgacactgatgatcctgaccctgtgtaggcctaggctaatgggtgtgttcttgtcttaatttttaataaaaaagtttaaaaagttaaaaagagttaaaatagaaaaagcttataaaataaatataggaaatataatatttcatattaataattataaaataagagaagatattcttttacagctgtaaagtgcatttgtgttttaagctaagtgttattgcaagagtcaaaaagtttttaaaattaaaaagtttataaagtgaaaacattacagtaagctaaggttaacttattactgaagaaagaaaagtattgtttaaaataaatttagtgtaccctaagtgtacagcatttatagtctacagtagtgtgcagtaatgtactaggccttcacattcactcaccactcactcactgactcacccagagcaacgtctagtcctgcaagctccactcatgataaatgtcctatacaggtgtgccattttttcttttatactgtatttttactgttccttttctgtttatatacacaaatactcataatttaattacaatttcctagagtattcagtaaaataacatgccgtacagatttgtatcctaggagcagcggactatactgtatactctagatgtgcagcaggctataccatctaggtttgtgtaagtacactctgtgatgtccttacagcgaaactgtctaataacacatttctcagaacatatctcattgttaaacaaagcatgattttattgtgcttgagagagctgaggaatgcttgaccttgggccataataacacagtgagcaagtttctcaatattgaccatgtttctcaatattctttaatgacttacctaaataaatacaaaactttaaagcagttcagtcaaaagtgaatgactaggcaaacttgtaaaagtgagtaattaaataacccactgggtttcactgttgtataccagaaatcaacatgtttaggactggaatatgtttttaggagcaggagaaggaaaatggttaggtctacactatagggcgcacagcatgggacactgtggggccctccaaggtacctcagtggggcatctctggatttcttatgaccatgaagacaccagggctctgaatattgaaagaggacaagggagtaatgaacccatagcaagtgtgtatcgcgggtacaggtacgtcagctctcctttggcgtgtacagtggagcaagggtaagaagcactgagttctgactgtgatgccagtagcactacctgcagccaggttcttccaagcctcaggaagaggaggatgaattagaaatacagctgtcttatccagccttattattttacagatatttagcatagccaaaaggaattcttactgtgttgctttggtcctcaaggatgatgatgatctagtcttatattaacaataattacttttatataatattttctataatgtagagctgaagacaagactgtttatgttaatggcattgataaaaccactactctagaatcctggtcatgcatgtgtatgaaaaacaaggaaagatggaaaaaagaagtaaaaagttcaccaggctaagtccaccccccaccaaaatatatatatatatatattagcaaatataccttggccaagaaagattttaaggcaagtaattgtttttaagaataacaaacaggctatatctctgatttgtctaaagattcatgttgtcatctccaaagttttccactacagagatttatgctgtcattggatctaattatgaattaatgattgattcatttagggagtaactcgaccaaatggcagtgaattgaaaaatgagcagaccctgaaggaacacattggcagtaataactaattctgtctgctgatggcaatcagcataggtcacttagaaaatagccctggatggaaccaattactcactttcaatccacagtgagtggtttcctcagccttgcactactgacatcaattaaccctcatggcattcttcaattatttgaaatctctaggcacacccatccttctgaggtagctacttacaacatttcaagtttgttttgctttctttgcaaaggttttaagcggaagagctgtgatattttccctctttattcttaaaagcactccgctcatccacgttggttacttgtttactttgtactcactaccgagtacatcttgacattttgtaaatgaatacaggtctacacagaattcttgaggtactccggtttaatagctacactagtttgatgctctatatggtcatattaaagatgtattaattgcacatcaagattgattttgctgcagggtccatgagaaaaatcccacacaaaaccatctattgttctgtcaactctctttgaagaggctactgtggtaggggttggtatggagagacccttgaagggtaaatgatttcatataaatttcttcaattagcaacagctttataattcctgctgcgagccatcaactacactcagattagttttaatggggaaactgtgtaccaagaatcctgccacagaaccccctaaggagagctgattacatttttttcaaatgcttacacaaggatgcatacttaaaagtgaattgtaaccttttcaaaactgacatttcaaaagaaacaaatattgagtagtgggaggaggaggaggcagtagaagaggcaatttcataagtgaaggaaaggatatcagaaggagttcttgcttttggtaaatatacaaaggcattgcatgcagcaaccacctctttctcttctgttttgtacaccagcttcttgcttttcttgtccatgtgttctcattatttagctcccacttatcagtgaaaacatgcggtatttggttttttgttcctgtgttagtttgctaaggataatggcctccagctcaatccatgtccctgcaaaagaatataaatcattctatcataaaggcacatgcaggtgtctacttcttaattcagtccctgcccctcggtcgagcactgaggttccacccatggttgcacccttggttaatctgggcatactcagcttataagaccttcacactgggagtcaatggtaactgaaaaacaacccccaacttcgttacatgaaagctgaggcaagttggtctggtgtggctacaaaatctatggtaaaacttttataggtgtttgtaagattgttgttagtggttttcctatctaaagtttcaaaaattggagttaagtattcaagggctattttatagaaccatgattacatggtcttttctgtgattcagagaattacagaatacaagttacaacacggttttttagaaaacatcacattccccagtttagtgctcgtatttttgggtcatacccaggtttatgggagcggatcccatctggaagattgtatctggtacatttatgagaagcattgataatttacagtggagcagaggagacaacctgcacaatcaagggcctggaaactatggaatgagagaagggctgaaggaacaagaattagaataagaaagggaagagctgggaggaacattaataacaatgacataacacagtacacagtagaaatgtaaatatttcaagggttattacaaagaacaacaacaacaactaaaaaaaacctttggatttgacagaaaaccagttcagctgaaagacattaatcagtaccttctaacttagaaatctcccaaaatggagtcccctatagcaaaatttccattatagcaagaaattgactactgcctagtcaaggatattttggactcgatttctgcctcagagtagaggttgaactagattgcctatggatattatacatctatttacttaaaggacaacattttaaatagtagattactagtttgatttatttgttatatttgacacatgcctctcagaaaccacatcagtttccaatattatcatctaggagtgtttatttagcatcagaagaaagctgaaaatcttactagatggagaaaaataatgccatggttctgtgtaaatacagaattacagaacattagatctaaaatggacttcattgcagaagtgacagataactacccagagagttttcagcccttcctacggatacttggttagtaatgggtggagcactgtcccctgatcatctctccacttcacagttctttccacccatttggttaaggcttagcccgcagcgatcagctcagcagtaacaacaaaggtctctgacaccaccttcctacatctacccactactcaccttatccctgacttgcacccgctaaataagcagcctcaggaatccagcctgaggctcagcactaatccccagtttttgctccatcccaccatagcttctgtcttttccgcatattctcacatcagcatctataagaggaaaacctcagtctttatggtctctagactggaatcccatcatagtccccaaaccagagagagaggagctcatgacagactgcgtgtcaatcccatccaaccagcctcccatcctcagctgagatgtacaccagaatttcccaactcagtctcagccaaacgactcaacatttcagtcaaataactggcccctctattgaagctttctaaatggagcagacaaatcagattgaccattgctgtgaggtttactgtttcttctattgttgaaaataaaaaataagttatgtgactccagaggctaccagatatttatttaacattaaatggaatttgaggctaaccaaaccttcttccttagtcaggacaacagaccagataacctcataaaccatatctttataaaataataatggatatagggcatgcatttgaaacagcaaggtaacttttttaaatttgtgactgtttcaaaagtttaagggcacacattccgatataattagcagagaatttactaccattatgagttaattcactgaccctcagtttacgttcctatatttgaaatataaagaatgtttgccctttaataacactatggactagttaagaagcaatgttttagaaaatgtattattatatttatctctccaatccaatcaggacccagtaatcaacattaatcagaagtgttcatgctttatgtacaaaactgtttcagaaatgtcaagagtgaaataaatcctaaagattcttcctaggtctgacttgtgacttaataatatcaatatgaaatttgttgcttatgaaggaattagtacttttttttggtgtgtgtgtgtgtgtgtgtgtgtgtgtgtgtgtgacagagagacagagagacagaaagagagagacaaagagagaaagagagatagagattttgtgaggaaaattatttagttctttcttgtccattaaatctatttgtgtgattttataaaaataagaaacaagttgaagaatgctaaagagaagataaacactatccctgattcccacacttccagtccagttcaggcggtgatgaggctgtgtcagcatgggtggcccccaattcatggtttctctctactctcctgatatatatatatatacttggacgtaaagataggaacaataggcactggggagtacaagaagagggagggacaaagtggggcaagagttgaaagcctacctatttggtattgtgatatatatatatattatattatatatatatattatataatatatatattatataatatatatatatatgacttttgttgtagaataaatgtaacacaaaatgtttctataaggacttaaaaatgccagtttgtcactgtggtgggctttgtggttccttctgacaagcatcgaatctattccactactttctccctctgtgtagaattcatgttatttgcccagcattggcatttgtcattgtccctagtaatcttctctccaccttcttctctctctaagaagctcatagctcttagagctataggtagacatcttgtaaccaggagggcagttagcctctgttaaaagcagtgttcagaggtgaaaagaagcatatccatggtgacccatcttagacagcagacactatattccctgaaacctgacctttataactttttacttattgggccaatatattccatgttgtgtatgccggtatgacgtggttttctgttatttgcaaccacaagcttgctccctggcacagtaattattcagaatacctgggaaagggcgaggaactgagtaatatattgagtgcctacactttatatcattttatcccactaagtgatagataccattttcctaattttatacataagaaaaatgaggtatatagaagctatgtaacttgaatgaagccataggggtagaagcagaattataatcaggactctctgaaaccaaggccccttttcattctgctagacaagcagctctcaatctttttcttctttatcatccatagcagatgaggtataggtacagaacacactcgcatgggcatatctagagctgaatgtaatcctgtcctcttcccataattcaacctgtttatctgctactcaagaaagcaaatcaggatgcaaggcgtagtggcatttcttgcaggataacttgacatttctttaatttaaaaggcaaaaagttactctaaccccactgaggctgtctgtagttttacttcaaattatttttgacaaatctcactgacacattgctcccttctgcttttcattatgcttgttattgaatgaatctttttttcctcctctgctccactcaacaacaacaaaaaattcagacattgaaatcctaacaacgaacgtgatagtgctaagggagcaggcctttggaaggtgattgggacatgagggtggagccctcctgaatgggattagtgccttgtaaaagatatccagagagctagggtgccccttcccccttccaccatatgagcttacagtgagaaggtgggaggacaaccatctgagaggcaagcagcaggccctcaccagacactgaatctgtcagtgccatgatcttggacagctcagcctccagaacatgagaaataaatatttgttgtttataagccacccagtacatggtattctgttatagaagccaaacagactaaggcaatactaagtggatgtgctttctggtactttcagagcattctggagagccaagaagtttttacccatgaagaaaatgagcactcgaggtcagaggtgtcaagctgagctcttgttatctttgtataaaaaggaaaatctccacaatatatttggtagcagtactagaggcttcccctaccagttctggcaccatccagttgagatttctcctggctcggctatctgcccagctctgttgactttgcactgactcagtttggttactctaaatgtacacacccaattcaaaaaagtttgagacaccttacaataaggtcatagaacttgtaattataatagaaacaaaggggacaacagtataaagttaggagccaagcagtcaactaaggagggggatgattagattcctggaagagagtccaggacacaggttgactttgaaatgtgactcaaacaccagattcattttttttttctgcctcatagtttcaaaatctttagcaagatgatgtaataaatatatttcctacacgacttcaattacctgggttggcaaaccagaacttaatcacaactcatagtcaagtaacttttaaaagttaggtctttatcctgtgaccctgagaactgatatcttggcagttgcctggggaatcatgtgaaatcacacccagacacagtgatactcactggctctgctgctgttggttcttggatatgtgggattacttttgaaagcaacacagaaaactccttgttttcctctgcaaataaattcccctaagaggtaagaacaggttgacaatattgcattgagtcatttttctctactctgcatttcctggtacatacgtatgtatgtatttatttattatttatttatttatttatttattttgagacggagttttgatcttgttgcccaagccagagtgcaatggcatgatctcagctcactgcaacctccgcctcccagattcaagagactctcctgcctcagcctcccaagtagctgggattacatgtgtgtgccaccacacctggctaattttttgtatttttagtagaaacgggatttcaccatgttagcctagccagtctggtcttgaactcccgacctcaggtcatctgcccacctcggcctcccaacgtgctggaattatgggcgtgaaccaccgtgcctggcccacttcctggttttcagattttgcttcaactcactccctatgagtagtctgttcacattaaaaagcaaccacactccaggaatcctggtttgcataatgttcatatgttttctctctctctgcccacatcgacctttccacagatggtgtagttcagagagccacagtcgggggcctgagagaaaaaaatgcttaagcttaaaaaccatgtgtgctgtctctgtgggacacatcagcaaatactcctggccacatctacagctcaccaaagacccaatggtacctctcatgtcgttttagtacatcatggatatttggtgattatgaacattaagagtctcatgttctttcctttcctttctatctgttgtgaaaaccccacactctactaaatctttacctaacatgtctcataggttgaaactaacttacttatccctaaaacatcacataaattctgcctatatttccttagccattccctttattcttagcttaaaacttcaataatagtggtttctccgtgcctgtattctcagtagaaagccacactgggtgtcacttttccttttttaaaaactcacaattgcagcactctcatctttcattttaaggagctaatcacatgtcagttttcccaaccagactgagctcttcaagggcagggacatgctttcttttgcatccccagccgactgtctggtgcagagtagatggtgcatacattttttctgactaaaaccatgaagaaatgaatcaacccatagtgtcatttaagatgaatgacccagagatggtctgaagtaactaactgggcactcactcagggaaagggaaatcactggattatctgtactgtttagcagccacaccaccacctactccccaggcatgaatgccagctttcagctgtgcaaaatcatgctctctcctagggagtaggaaatctagatcatgcccatgtgcccagcttcctgccaagtgtcatcgtgactgcccagctccctcagatgacagtaataaagaaaggacttaatacaccttactccagcatgtctgggaaatcatgctgtcatttataatctctttggaagcacccaacagatgcattcttttgactaactttgatgtctgttcttgggttaaggctcctagtctgatgctttctttcttgaacatgctcattttagtcaggggctctattaaactattgtttgtcggtgttgtccatgagaaatgagatgaccgttgaaagtgtaccatgccatcacactgataaggactgttatctgaaggtcaaggacagcctcatggtaccagggtagtggacatcaaaacctggcagagaaaagccactcatctatgccagggctataatctgctttcactgcctatcccctgcccagtcccctaaagcttcgcaccttcatgatccaatactacatataacgtctatacttgtcctgaagccctggctgcattctaatgaatgtgtgctttgttaactacagcataataaacatgatgctataattatccatgttttcatagagctgggaagctaatctctttaagaattgatgtccctggcagacaggctcagcattttgcaattgttttgtgataatgcatggcttcatagtgggtttgttggtctcagcattttagcaatatctggatgaacaccgtattgagcacatttttatatgtgagtctgattagcagtgagtgttgttaaaatctcattgttatcccgctctgcttccaattccattctatgaaaaggcttattactggaacctgagactgaagctttccccagcagcttctggattctccccctcactctaggttaagtttacgcatggatcgagtagtgagatttgagtgactaggaatgaaaacgtccactccacatcccatgttgttgctgggcttggcactgtacattccaggactaatgagtcaatattttggacctagtacatattttcttctagaatattctttattcattcattcaacaagtcttggaatgtctgttctgtgtcactctttagacacttagatactattttcagacaaacaaaatgctctgacattctagtggtgtgggggagacaacagaaataaatcagatacatacataaaatatacaatagtggaataatgatatatgcttatgtgataaggaaaagaaaacaggaaatgaaggagtttggggaggaaactgtaagttacagtttgattaggaaaggcctcattgaaaatgtgcctttgagtaagcaccctgttaaagaatgagtatctcgaggggacacatgtaaaaagatggaattttaaccagtaataactagagctattaacagtcgataccttctggggggataatcttatagaatggcccagctgcagtggaacaaactgtagaacatagattgaggctctgtgtggtgacaccaaaaaggaagtctcctaaatgtatagtttcgcctgaagcgggcttagccccatggctgggcagggccttatgtgctcatcttctcaccccacctcctaacagggcttcaggatgcttggaccaggagaatcatcctctaaagaacatgaattacatttgggagactgagttctctctacttggaaggcccaggaaagatttccccttttttctgctgctttcttccttagtagatcttttgaaagtttcttaaatttgtaaaattgctctcccctttccttgaatctttagtcgttagctgtatacagagaaaaagtcccatgtataaattggtcgtttgtgttatattcacaggaatgggaattaagcctgaatttttaaaatgttttttcagaccctgagtaaatattagtagaactcatctaccatgaaattatggaaaacaaaattgtgataatacttattctgcaatatcatccagacttgcaagttgctagacatgaaagaaataccacaaactggaactggaatatgagggagaatgtggggtccatggaggacactgcaagtccctttctgtgattgtctccggctgacttcagacgcaacattaccatggcaacttcgtgaaaacaaggagggtaggctgagctcttcccagctactgaattttctgagtctctctctattgtctgatgatcttcctgcctgagatctcccactttttattaagcaccacgggcatgagatgagagctctgcccccggctaggcttgttcccatacgtatgttccagtgagcgtgcacaggaagcccgggtctgagttaaacagcgaccacacgtgggaaaagttgagtttcttcctttgaaggttaatgacaaccaagctaggttaaatgaaacacctgtctggaagaaacactgacaacaggcatgctcataaatagtacaggtcacccgctgagctgactctagtgcaaccttctctcgcagtgctgatattgccgaaccacgaaatcatacccaccagcacgtcatttgttagttagaaaggatgtcattttgaacatcattaaatgtatttttttcacacccccaaaaccaacataagatgaatgtcacctgtgaactgtaaaacgcatcagctgtttcttattgaaaacataacacagcggttttcatacttcagcatgcagccaaagggcctcaatggctcgctaaatcagagtactgggccccacccccagactttccttctgtaaatctggagtaaagcctgggtatctgtactaacagaattagaagaatttgaatttgttgatgctgctgcttctgggctaaattctagaaccactggtctagcagagacctctacttctccatatggctgcccctgcctgccagggaagtgcttctttcttcatggtaaaaatgtaaaaacattgcatttattggtttttttttttttcgtatagtttctgattttctgaaagctccacagaatggtcccaaagaaagtgttcatgagcagcttcctgtgaaacacaactagacaaataactctatccattgcagatgtataattggaattcaaattgatttgtgtgcatgcttttttatgagcattatttataaacttggaattggagtgtctttatggagtcattactaccattcagttcaacactaagtgattcttctttgcatccaaaattggtagagctagcagatgagcactgagttgaattcgtacactatttgtctcattgaagtactgacagcacatgccacagtccacgtgctgtttcagttatgctcatattcatgttatgttcggaaaactctctctgtgttttctattctcacactaaagcaatcatcaatacagaagaagacttctgtgaccatatgtgtggggtgtttttccccacacaccaagcagtgaacaccagctgggtgtcctctaattcaattctgactttatctacctggagacagtgtcagatctcacaggttgagggctcagtccctaagactgccctgccttccactcaccccgctaccagtcccaagtttgagcctccagaacttctgaccaccgggcttcaagttgggattcccatgatcctttctttaggctcatcaattttctggagtggctcacagaactcagggaaacatttacttacatttgctgatttattataaaatatattgcaaaggatcaagatgaggagatgtatagggtgaggtatgggggaaaggacatggagcttccataccctccctgggtgccctaccctccagcagcctccaggtattcagctccctggaagctcttggaactctgtcctcttgggtttttatggaagcctcatgacttcagcattcctacttccagagaatagggtgggatcctctaatgagagagtcttaagacccacaatcagaaagtccagggaagattagagtcctactttgggcaggtaaaaggagggccagacatcaatggcctgcctctgagtcctaatacacccaacattgtaacaaaagactgtaacaagggctatgggagttatgagccaggaaccatggatgaacaccaatatatatcctaacaccacatatgtcatatatgtatatacataagtacagaaacacacatatatatgtgactatatatgtgaatcttaggacatgtatagacatgcatgaaaaatttcaaagaaatgactctatttttggagcattaattataagtgaagccatttggaacatgaataaagaatgcttatagcatttttaagattaaaattcattttaaaataaatttattataataattacttcaaaaagcaatgcgggcaagctccaagatgacagatctctagctgaagatggatgacaagctgctttctctattaggcctgcaaaacaaatatttttaagtcctaaacatatagaacagttatggaatacctatggtgtgcatgttagccattagtttaacaataatgttaacatatgtcctttcaagaggagataggaccttatcaagtggatttattgaattacatttgctctaagatattgtctgtagaaactgaataaggaaggagttcagtagaacagcagcaagcatttcctgaatgttccaagtggtggctgtggggacacatctagtaaggcctgaggaaaacatgacaaacagggacaggttttgagaccatgaggctgtctctggaagaacctataaaatccttttgaaatatttgctattttttcttgttacctgaattaaattttctttgacaagtgaagcagttagagttcagatgggttacttgcccatattctcttaaattatattggaatactggcaataaactttagttcacttttcccaaactgaaatacatttttatatacaatctaaacagttcttagcctgtattccagcaatctacgaggccctcatggggagagaataatgatctgtggacttggctccatatcactgagaacctctgctctcccatcaggagagaaaagacagccacagttgttgaaactcagggagcagggacaggcagacatggcaacacacactgaaatgttggatttttgcatcaagccctatagcacttcaggaaaaagaaagaaaagacaaccagttaccttatgtctttactttgggatacattctgggtagaggcatattttgaataaggacaaagtactaacaatatcttggcaattaaacttaggaagaattcgctatgtaattggttgttgtttcatcaagcagggcctactctagaatttctgtattggtgtggctcaggaacaacagtgtagttagaaggaagaggttaaggactctttgaagctcatttgctaaataaaggaactgattttacttagggaataccaataaggtttaaaatatgcctttatttaaatttcacataatattctttctacttaagcagttctttcttcatgggggctggaagaggaagccaatataagttattggggatctaaagcattttacactgctgcaaggtgcccagaaagttttaaaggtttcgtaagtgatgttggtttctgttaggagaaaattcttccccagtcttacttctgaagaatcaggaagagtctcctttttttattttgactatattactccaagccacttctccctaactgcattttgttatatctagtaatgctttaatgcccccttttgtttattcaacaactctcaattagcaatttttgagcactaatgtgtagttgcagaaatatcagttatgaattctttaagaatctcagaaaataaatcctatttgacaacatgcaagaacctcatcacatgtaaaatggagctggtgactcaaagttggcatactttctgagccactttggtcaggttgcttttggaagatactgctgctcaacactggatttgcagaatctggtgcaggagaatatttactttcttccacaacctcagataaaccaagttcaatgacagtgctgcatcatttgtgtgcctggcctcacagtggatggcaactgtgattatccccagagtctggggtccatgccaggagctgcttcccctgacagaaagcaggtgtctgaacacagggaaagggaaaggaaaacagagccctgaggagctttgaaaaattctagatctggcttgatctctatacaagtactttggaaaggtagttcttatgatgaggtagcttgtttgttgttgtttttgttgttgttgagacagggcctcactgttgcccaggctggagtgcagtggtgcaatcttggctcactgcagcatcgacctctcaggctcaagcaatcctcccacctcacactcctgagtagcaaggaccataggcacccaccactacacacggctaatttgttgtatttttggcagaaatgggtttcaccaagttgcctaggctgttctcgagctcctgagctcaagcaattcccccacctcggcctcccaaagtgctgggattacaggcatgagccaccactcgcagccataaagtagctttatagttttccttaacttttcccccctccaaagtaaaccttaaacagacttccaaaagaaagtggttttaaagtgtctattgccataaatttcacatggaataatttcagccacataatcaattcttgtgggatttcatgttatcagaggattttctactagtaacaaatttcagatattccatatcactaaatatgatttcagcctctgtggtctcaggcgaatttgctgttggtctccgtgttcttgttttgtcagtatgttcctatacattacatagcactttttccacaacgagtttttcctactaccttgaatcctagtagatgactactttttctaattttgagaaattgaacatatgcaagttcatttaagcaggtaatgaaatatataatgccattgcttaccactttatccccttaccttatttcattttactttgtatcattttacatattaaataattgcctgtttgtttatctgctcccactatcctttaagcacctagaaaaatgcccaactcaggagggtcattcagtgtatgtttggcaaatgaatacttgatattggaagggcatccagttctctgaactttgaatcctgatacactatctaccaactcctgtgtctgtgtcctgaaacgtgtttatcattctcacattggtgctggaactatctgaaatgatatccattccttttgagcttgaatgcaaaattagcaacatcattttacaaatgtgacaccaggaagaattaatttcttgaaagataactcagtagaaatgatttcatcattaaggggaaagttatcagaattgcaaaatgcaaacatccaaaacaatgaagggaaactaaaggctttacctgaaacatccaaaaagtccattgtaaaactgacagaaaacaagtgtagggatttatttcagctttactgcagtgtgaaattggccatttgttatagactcttcctataaatcaccaaaattagaggtatatggtgtgcagatctttaaaaagattcagagtttcttctgatcaatcacacaaagacatcaaataacacctacactgcacctgggtggtgtttttgtttgtttgtttgtttgtttgttttgtttttgagacggtcttgctctgtcatccaggctggagtgcagtggtgcaatcatggctcaccacatcctcgatcgcgtgagctcaagcaatcctcccacctcagccacccaggtggctgggactacaggtgtgcacaaccacacctggctaattttagtagagacaaggtatcactgtgttgcccaggctggtctctatctctgggctcaagtgatcttcccacctcagcatctgaaagtgttgggattcaggcatgagccactttacctagccaggtgctttttttaagtaagcattctaaagtgtgtcagtcaatcactttcaaacaaaaggcaataaatgatctatgcattgcttcaccttgtgttaataaatattttgtcagccttacctcatggagaactgtaacactcttggtgactattatggtattttattgcttttatttttatcaaagttagatacatcaacataatttaacaatcatttagttcaacaatcatataaaaaacatcattttcttctctgtctcccattcctaatttctgctctcaaaaggaaacaatttacaactcttcttattgtttattttgtcatttacctccaaatcactcaaaaatgtgctttagctgctttctcttttttagctttatacaattcactagtaaattttcaccttgaaagagatttaacatttttcgctatcccctaccagtttcaaaccctcccactcataattaacctcctactacctacccagtataagtaaatcataatttttgatggatcagttttcagtgtttacataactatgtaagaactattcataagtgagccatgtagtgtactacatttccattcttatagtcatatcttttcatttatttgttttctacctttttgtctccaattaacctccaactctactccatagtataaattggtcaatatgttcaaacacattggctcttctataaattttatcttcttggagacatgtttctcagaaccctctggcttaaaatagagagtttagagtagcctctctagacctattcttcagctgtcatccgaagagctccctcaatcatcattttgagggtgtgtgatgttcatgtgtgtgtgtgtgttgtctttttttaataaataatctcctattgtctagatcccatgtcttttgcatttttggttcactctttattatgataaagtgtttccttcagtcttgaaaaaaaagggtgaaagaagatgttttgttttttcttagaatctatgtgtccaaaattgttttattccatcctatcattcaaatgggagtttggctataaacaaaactgtaatttcaaaattgttttcccctcaaatttttaagacactagtttgttcatgagcttccagtgttggattaaaaagtccagagccaaccaggctcagtggctaatgcttttaatcccagaactttgggaggctgaggtggggggatcacttgaggtcaggagttcaagaccagcctggccaacatggtgaaacccggtctcaactaaaaatacaagaaaaaaaaaatagccaggtgtggtggcacatgcctgtagtctcagctactcagtaggctgaggcaggagaactgctagaacctgggaggggggaggatgcagtaagtcaagatctcaccactgcactccagcctgggttacagagcaaaactctgtctcagaaaacaaacaaataaaaaataaataaataatgcaatttaaaaaagaagtccaatgctattctgatttcaaactacctgtagaacatctccttcctggcccaagttaatagaatcctctttttgtatccactgttctgaaatgtcctaacaatgtagctttttggagtaattttcattcatttttctggatgcttgtttgtgaggagaagggtcttttatctgaaaactttttcttgtgctctgagaaggtctattaaattattgtgttttctgttctttccttaaaaacttccatgattttgatattgcaccactcatcttttttctattatccatttttttgcttttaattctattttctcaaatttatcttatttttttcatctattatcttttaaatttcaagctctttttatgcatttctgatgtttctcatagcattatatctttgctttataaaggtaatctcttatttttctgaaaatataaatgacacatttgaagttgttcttaattattgttgaacttttttctccctgcaaatctttcttctttgttgctttttaaacttttaaaatgtcttttatgttaaagttgtgttttgatccctaactgctgacatttaagagtgagttaataaaaaactccattcatgtgagtggggcttgctgcctgtggacctcactgtaaatctggctagattgcttcactgagaagactcaaatgacagtactcataggtcttttctcctggtctggtcaaatccctcagagaggctctttcccctgagagtaaaaacacaaatcccagtgttctggaaccacatctgggaagagagctgagaagtggcagtttttaatactaaattcatagatttttgtgtaaccctctagctttcattatggaagctttactcccaattagctttggttgcctactctaaattctttctggatcaccatatctagagggtaagtgttccatcttctgccagaattaagaagggacagtcattctgctgcatggagtgaaaaggggtttctcaggtctaactgttctttgttttttttggataaaacaacatgatatatgtgaactttatttgcgtaactatgaaatattaaacaaatgccagattaatcaacatataagaacaaagtatactcagaatttagaagacaaaactaaacatgaatctagaaagggtaagcatataatggatgacatctctatctataacagtcatccaccataaaaagaccatttgagttcctctatcccaagtccaacaaggtaattaggtatttcagaaaaaaaaagtgactaatttgtaattactcacgcaatatttaaaccacatgttaaaaacgggatacatgttaaaacatgttaaacatgttaaaaatgggatagtgtctacccatgtacctacaatcaaacataagaaagagtcctccatgcagttaaatgttccttatatgtcattgcatgattgcccttgttctggctttgctatttgtttttcccacatgcatatatatctaagcaatgtgtagtaatttccatgttgttaagcaggcaagtattaatgcagtacactggctacctaaaaaggcagaagctagtttcagagttgccatggctcttgtatttctgatctcaggagcacataatgagacactgaagtggtggaaagaggtgccatgtaagtatctatactcataattgcaagcttgcttggttgctaaataacatttagaatgaatgtttctctcaacattcagtctctttgcgacataacccatacttgaaggggtgatctcttcaacaaaaggtatatattaaaggattcaggcaaatcatctggttgtctgagactgatggtgttgctgcctcagagttccacactcatattattttttggatcagtttttcacctgctggtttcttctagcatttcaggctactagccttcctttggtccatctagctcatagatgccctatagagaatttagaaatcattcatttcccttccatgcccacttcagaagtaacatgcaaaggaatcatataaacttcattctagtaaattatgtattcagtgtctatataaatagtgggtcagaggcagaacagatgatgttgctcaatagcttcaatgtgacacctttgagggtcccatagaagacgctataaatcactttgcagaacacctttggaattagtggaaacatagatgccaacacatcctctgaattgtctgtcacattggcctagagtgtaatagttcatgggtaccgtactcttagcacccagagccaatgctaaccttttatctgctttatatgagttcattaattattgggtactttggcaaaatctttgccaatgtgtaacatttgtaatacataagaaactgaaaatctcagattgattttctgaatgtaattctcttccactgttggcataccattttagatgtttggtaaaatataactgttatgcttcttctcccaagggtttgtaaggttgttatattatgtcttatttttatttttttatcagtgcaaaaagtaaaacttacagaaaatttttaactggagtaaaataagagaaatgtcaaagacattatctagagtcccattaatcaaagggaattgctgctaattttgtgtaactgtatttatttatttattttgagacaagttctcactctattacccaggctggagtacagtggtgcaattatagctcactgcgacctctgcctccggggctcaagagatcctcccacctcagcctcccaagtagccagaactacaggtgcacactgccacatctggctaatttttagtattttttgtacagacatagtctcaccatgttgcccaggctggtctgaaacccctgggctcaagcaatcctcctgcctcagactcccaaagtgctgggattacagctgtgagccactgaatccagacttgtgtatttttttcaacttattttatcttctttctatgagaatagaaacaaaattaaacatgctatttttaaaagataatttttgtgattgcaataatacatgtttactatagaaaatttgaaaaatacacaactatataagacatttaaacccagaattttactactcagatacaaacactttaaaactttatatttacatatttctttaaggcctcatttttcatttttaatcaaaaaagtagtaaatgcttattttaaaaactatagataacacagatttatatagcataaataatttagattcccctttcagccctattatcccctaaagttcttcaaagtatagcctctttaaagtttgttttatattttcccagacatccttctaagtgtttacaatatttgtataaagtacaaacaatccttgaacaacatggggcactgattccccttgcagctaaaaatttgcatataacttttgactctcctaaaacatattaagtaattactaatagcctattgttgatggaaggcttaacaatgaaatagtcatttaacacatattttgtacgttatatgtattatatattgtattcttacaataaaataaactggagaaaagagaatattattaagaaaatcataaggaagataaaatataattgctgtttactaagtggaagtgaatcatcataaagttcttcagcctcataggctgaggaggaggaagaagaggaggagttggtctggctgtcttgggaactgagttgaaaggaaattcacataaaattgaacccatgcagctcaaacccatgttgtttaagggtcagctatacatatttcctaagatccaaaaatacaatgcctattatacacactaacctaaatgtatgtatgcaccaaactttaaatttactgacataaatacaattatagcatacatcctattccacaacttgccttttaaatttggtcattttaaatgagcacctcttccactgggcatggtggctcatgcctgtaatcccaacactttgggaggcttgaagttggtggatcatttgaggccaggagttcaagaccagcccagtcagcatggcaaaacctcatctctactaaaaatacaaaaattagcagggtgtgtcccagctactcaggaggctgaggtaggagaattacttgaacctgggaggtggaggttgcagtgagctgagatcataccattgcactctagcctgagcaacagagcaagactgtctaaataaataaataatgaaataaataaataaatcagcacaccttctatctcactgcatataaattgatctcattctttctaaagactgcatggaattgatgtgcaataatttatgtaaaaactctccaattgacagacacttgtcagttgtttccagaattattttccattgtttactgttacacaaaacactgctgtgtgtatctgtgtacataaaccattttgcataggtatgtaaaaatttttcaatcaaatagattcctagaaatagaattattcaatcaaaaaatatacaaatgttaatggaaggtccaattgctttccaaaaaggcagtgtaagtcacaaaaatatataaacatgcccgtttcttcaaactcttactaatactgaatattgttaatctttaaacatttaccaatctgagaagtacaaaaatactggtttttattttaatatacatttctgtgagtttgagcatttatccaaacacgatcttttgcaagtagactgactgcttgctgctggttgtctgacattctggatagcagatgaaaagctacattccccagcatgcattgcttccagggcttgtcttattcttacctttgtctacaataggttaatgcgttccttgtgtgctcgtatcagaatctgaggaaaagagtcaagagactttcactacaccatccatactacaatctcattcatttcctaggcatgatattagagtagatataagaaaaatcacctatggggacaaagctaatgcagtacactggctaccaaaaaaaagcagaagccagtttcagagttgctatggctgttgcatttctgatctcaggagcacataatgagatgctgaagtggtaggaagaggtggcatgtaagtagctacactcataattgcaagcttgcttgtttctaaataacaaagcacaagtaggcacccattgtgctttttggtccagttatagcagtaattacttctcccaggttcttcaaatggcctattgcttgtgtattactttggtgaattttcactgttttggtgtcttcatcattatcactgtttggatttggaaaggccatgtcatgagtataaaccagacactatttcaaaccagaagtttctggaatgcctctggataaattattctctatgatttcacttctatttaaacataacctttaaaaatattggaaagtgtaagaaaaggaaataaaattgtagatgtttagggcttgccttacacttagaatgctgtccctgggattctgacagagggtgccaagaaagcagcacagctttaaatattgaatgatgggatttgtgccaaggtagcatatggttttatgtgaacaatgaatattctattatctcatgtgtgatgccagggaggaaagtggatttgtggagacctggtgcagctgagcctacacaggagacaatccttttcattactgttgtctatctgtggtctaaagatggattgaaagactcacttgaggagggcagacaagggtgaagttgttaatgagttacaactgtgcccaaaaaagacatcagcaattgctatgatcaaataaattttaatgacttgagagtgtctctagtgatctgtattttatgtgagctgcctggattttcttacattagcatcatggtgatttcaaccctgtccttagagagatctccactggtacatgtctctcttaactccttctcagttactaacataggaccacatctgctctgcaaatctcagacattcaattttcttctatatgagtttgccgaaagcaaagataactagatgaagccttgtgtaaaaaggactatcattaataatagtaaaaataaggttcttgcttatggtgttttaagttgactgtcaggggctacatcttgtttatttatttctgatcaaactgaaaaactcaaaggccagtaatctgatggtgagtgaggaggttagaaatctatattacagggcttcagtgatttcaaaaagtgccattgtttgagtctgctttaaaatacttgtagaatttcaaggccactatttaaaatggcttctgcccaccagctcagtgatggtcttaacatgatagatttgctcctccaacttccagcagcatttagatatcaagtgttggggtcagctgttactgggcttcaagctgtgaggagagcctgggttgactattccccattgccatattgattggcacacaatgtggcatgctatggagatgaaggcatcctctaagacagtgctgctcaaatttgaatgcacgtaacatcacctggggaccacattaaaaagcagagtcagatgttgtacttcttgatgagacacaggattctgcatttctctcaagctcccaggtgatactgatgtggatgctgctggttcacagcccgtactttgagtacacatggccttatgttttaaatcttgtaattctagctgaaggtacaaacgcaacctctgttggctcctaatctcttgccttgttcatctcatagaacctgtccactcttatgccctcctggactcctacctgcacacaagtgaacagaaattcaatttctactgtgacaaaaaggtgatctatatttcttctgaaaataccttcattcctcacaacttcaactagctagagttgaactttaataaatgaactgaaaatatattcagtattttaatgtttgaaacatacttaacattttactgaacaagagatataatacttggagcatgtgttaagaatggtagtgttgatgaaatggtgatcaaatatattttagattccaagctattacttctctgtcaggactcagtctgcccctgtccaggggcctggggctatagcccttacagagccacggctccccctgtgtcgggggtcattacgctgcactgacagccagctctgatgctttccattctgtccaggcaccacagagtcctgggcacctttaagtgctcaatgaatgttagtggaaaaaaaatccttattggaacaaataaagcaaattatggcacgtcaaaccagtggagtaaaatgtcagaaaataaaaattgtgaaaattctaacatggaaattttatattttgttaagtaaaaaagagctggatataatagtgtactttttatgtttacaattatatgtatgtatgtacatagtttataaaaatatatataatagtatatatatacaattgtaaacatggaaaatatatatatgatgaacaaataaaatgaaacattgaaaaatgaaaacataggctagtcatggaactgattattatttaacttctttataaaattattcctttttcatattacagttttcagtaagttacaggtaaagaagaagctatgataagtaatattttagcatcattaggtatcattcttgcttccctccacatgcttaatctttcaaaagcctgctctaagactctctagagaaattgaagcaaattttgaaaacatttaattaactttaagagtgaataaattttttctagattatgttcatgctctccttttactgtgaacgctatagtatttcctaaaatttgctgaaactcacagggtccttaagaaagagcttttgcctatacattttaatattttctcacccaggcactcagtaaaatgagtaatagtctgtcagtaattcaccttattaaacgaagtatagcaaaacgctcacatctttaaatccaattgttttctctgctgcacttctttttttgggggatcggaggggggcctgttccacatagttaggttatttttgtttaatttaaaatttttttttccttgtcatactgtgtaaaatttagcctcaataagaagtatggcctttcatctttctgcttaaaactgaaaaatttaaaaaggttttcccataaaaccagctagtggctgataggatcactttaaattttgcatttttacctgagaagtaaagaaatagtctgcctagaaatttgacaacaggagtccttgtaggaatagtttggctaatggcagtagataaatctctttttcttacactagcctattgatccttctcttatccaagtggacattctttctcccattcttttccctgccagtttttctctcttctctatctcctactctttttctctcttaaataatctgccttgctagataaaagttttagaattgatttttattccaaacttactaaggtgatatttacatattcaaatacatgcacgtgcatacctgaacgtgtatactgtgccattattctacactttgagaagcccaatactcatgaaaagaaaaactgagtctccctttgctcaccttgtacctctagggcctactagatcactggacatgggtagctatttgtatgtttattcaaaaaatggctatgtggattaaagtatgaatggatcctattagtgagataaaaactagttatggagaccaagttattagaaactcttacaattataatacatgggtccacatttgactgctcttttgctagcactgtcaatcatgtagctatgttaagaaacatttctctttctcttttgctttgctatttgccatcaaactatggcctttaaaaggtgtttacctttttattttcatgcctgctccccttttttcctttgataaatatgacaacacttagaagctttaattccatcttctttgaactaggacagcacttggtgtatgattctcatatgtcattctgctttatcatttggagacttatcacccttactagattttaagttcttttaggaacgtaatgatttctatgggattgtgcgcgtgtgcgcgtgtgtgtggtgggggagggagttgttgttttcagttgttgtttctctaaatctttaacagagacctataggttcctagaaaatcactggcattggctgaattgaacttggaatttgagacattctctatgaacaatgagacgcagttacattaaacagtgtttatccaaaaatggagagtagaaatgagtttaaaagagtaaagttctcaaggaaaactctctaaagcaaaaatgcagattggatttgcatgcaaataaaaagccttgagtgtatttaatgtgacccaataaaattagaggtgctacaaattttaaggaattttatagattcttgaaacagaatctcctttgttataggaaatgggaagaagagtgagtatgtacaagaagaagagttcagatatgtttttgtctggcacaaggagaataatacaaattcctagtatatttctaaatcccaactctggtgtcctaggagcactttgtaactattgatatctgccaagaggtcctgagatcacctctgccactctcttcctcctctctgccactgcactgcagtttttgtatggctgaattctttgcctgtctccttaacatgacggctttgcatgggtcctggcatcacacttaggccttgaagcagagtagagagctaaacacataaagtattgcttatacaagtcacagagtgaataataatacgaagagagaaaacttccatcaggtggttattctggaattcaagaatacaatttctatagctacattaattttttttaatggtgcttctcctaagtagataagagggaatgaagaggaacagcgggaaggaaagagtaaaagtggagtctctagtctcctgtacttcattcttaggatctacttctgtaatctgaacagtcatacggcagtagagtttttgttttgtttttggtcttgatttttagaactagctggtttagtttgaaacatcagtgcaattgaacatgatgaggagggaaattcaaggagttgtaggaattatgcctaccagtgccttagtaattattttaatagagaaacctaagaaagaatctttaaaatggagagaaattgatattgtattgtttgtatgtttggtgctggaatagggctcgcccctgacttacaaacttttgacttagcccacagaggtcagagaggacaaaacactatgttgtttgaacagttgttttgagaccgttggaaaatgagtttgtaatgggtcccatgcacagaaagcagaggtatatcattataaaaaccaaccagtcactttgttggtagttttagcaaaagaattttagatgcaggactcaggtgggaaatatgcaaaacatcttattcttggaatattggtagacaaaccttcatatcagagatatttctggccatctacattttacttatcctgcttctttggcttgattaattgctcttgaaaacacttgctatacttttactcaggtagaaaacttttctctttgatcacatttcttggcaaatgtttttgatcaaatttcatggaaaatattaaagtcattaaaaatgtgggcctttccattatgttctttatgccttgatccaggacataattcatttactagacacataactattgaatttcacatcttctgtatattgcggtgcaacacatataattgttgtgaaagttgacagtgaagacctcactgattattgtttgagctacatttacatatcatgatcagttgtaatgtttcttgttttatttccaagtatggttctcatttctcatttattttaagaaaatttattctagttaacttggttaaaagaaaaatagtactctgcttccagatcgtcactgaaaaaatactagttcataattttgccaagctattcacagcatgagtctgataatccctcgatggagagtttgatgatttctttgcactgttgatctgtcataatgcaaaacttccaaattcttcttagttaaaccataaagagaaagaaagtccaatctcaatgaacaatctattcacatctcctgttgttatggatgtcactatttaatgagtgaaggagcatccaattcttattaaactgtatcctgaatggtactgcatggaacaaatgaaaaatgaaacatgccatttctgagattgatgccagttttcctgcttctcttttgtctggtttgatatgttgaaatctcagttaatgctcttgacaagtatgtacactttcagttgccagccaggtcttaactttcacaaaagaactgctggagaagttctggccctgagaaagctgctgagataaaagccacctttcattaaaaacgccacttctcccctgtgtgtggtgtgccctaatgtgcaacaacacaatcactagaaggtgattctgaaagcagaggtagaaagaaaattgctggatccatggttggcagcacagggttacatgaagttggccatacaattgcaatcatgctggtaagtcaatatgggttgccatggagagatggctataagaagaaaaacagatggtggtagttgtggtggagacaaagaaataaaagccccaaatctccttccaagtaaaagttacatagaattcagcaatttggggaagaatgacattgtgtatgcttggaaagtttatattgctatttttatcactctagtgcagaaatgtatcattaaaatcatcacattattcacctacttaattcccagctctggactcaccccttccacttggcttgccaaaccattctccttatttcattcaactcgtgtcaatacccactttatttattactaaatctattatgatttaaagcaagattgcccactaaatatttgcattacaaattctctcaaaaagtttgtcttttctttctctgaagaaaaatgaatgtcatttaatacagatttattgtgcagccacaatatgcaaaccattgttacattccttatttatatgctatgctataaaaatagaagctgatctaggccttggattattaaaaccttgcatcttacagtacaaatagtttttccctctaatgtttacacgatgaaaatgagcatgttgtatttttatactgaacactttttttttttttttgagacagaatctcgctctgtcactcaggctggagtacagtggcgcgatctcggctcactgccacctctgcctcctgggttcaagcgattctcttgcctcagcctcccgaacagctgggattacaggcacccaccaacacacccggctaatttttgtattttctactggagacagggtttcactatgttggccaggctggtcttgaacacccgacctcaagtgatctgctcgcctcagcctcccaaagtgctgggattacaggtgtgagccaccacacctggccctgaacacattcttatccataagtttctaaaaatgtacaatttaatgatggaaactcagactttaatcactattataggagaggatttctacttttacttgttccaatatttagcattaggaaacaatatctcttgatggaaaactagatgcatgccatttcctacttcacctcaacatacagcgatgacttgtgttagtagtttcctaataaagcacatcagtgaaattttgctaccttgaaaaaatagatacttttctttgtaattccatagagggacatgtaatagaggcaatctcttacttgagattagaaacatctttggaacacttatggcctcatgatagaataatttttctgtacatcactactgttaaaaacaactgtaaacatcagatttttatttttagaaagttttacttacatcagtgagctaacaagaaactaactagttctgaacttgagcttcagtttccaagattcaaagaatgagaaagaagagacaaatcctaaaggaatactcaagctaggagtctaatagaagaatcttttaatgaagcaggaaccccaaacaactacaacttcaaaataaatttgaactagacctaacccatccccagaaaataaatcaaattgtctgcctccagtcttggttttaagtggagaaacagaaaaatttctcctgaatattcacgaaaataagttattctttacatggatttgtaaactaaattcacatcacttgaataattaataaaacatataagcaataatttattttaaatggtactaggctattggtacctcaaggcatcaggcaaacagagatgaaaatccaaaaacaaataaaattcctacctgaaattatttaaattcaaaataaatcacaaaattttccaaagatatgcttaacaataatcctggtgttgcacattagatttccagacttactcatcctacataactgccactttgaaccctttgacttatatctccccacaccccacttccacccctgataaccatcactcactctctgtttgtatgtatgtggcttttattaattctaaatataagtgagattatgcagtatttttcttttcctgtttggctcttttcacttggcataatgccctccaggttcatctatgctgtcacaaatggcagaatctatacacacacacacacacacacacacacacacacacacacacacacatgcctagctatgtgagaagatggatatgtcattttgcttgactgtagtaattatttcactgtgaatatgtatgccacaatgtcatgttgtataccttaaatatatgcaatataaaaactcccaaagataaaatttcaaagaactaaattcacaataaaaaattcagaatacataaagaaccaaggtatcatacttgtgaggtgatagaaaaaacaaatagctgaattaaatccacaaatatatttgacatagaatattaaataagtataaggtaatatgcttaaaaaatgaaagagttttgaaatgaagaaggagtaaaatgactaagcatatttgaataagaaacaaaacagaattaacagaactaagatatagtattttttaaagaaaactaagtggatagggttagcagattcaaaagaatggaagaaaaaagagtgtgaaaatatttctaaggatattatacagaaagtagtacagaaaaataagatttagaaagtataggcaattaagagacatgggaatagaatgagaagttctctgttacttactggaggtttagtaggaaaaaaagacagagatatactaggataagtgtaaatgtttaaagaggaaatggctgtgaatttttcaaaacaaatgaaaagcaacaatcatcaaattccaggaagactgcaaattaccaagaaagatacattttttaaaattccacacaaagagatattgtagtcaatcttcaaaacttcaagaacatagaaatattttaagacctgatagagtaaaagaaaacggacaaattttctccagaagaaaatagtcacttcctgctagcatcatgagaatcaagcacatttttaatatacagaaattaaaatgtgcctaatggaaaatgtctaaaagtatttcagtgaaataaacataccttcaagtgaaaaaaaatggaaatattttccatcaagagactctcatttaacaaattggaaagtatattctttaggaggaaaaatatttttcagaaagaaagtctgagagacaagaagaaatgatgaacaaggaagtggtgtatatatattggtaaaccagacactaacattgactgaataaaataatattaataatgtcaatagaacagtatacattagaaaatacctatttggggaattatggtgttctaaggtgattatattgtctttggaagaagtaaaagataatgattaacttcaaacattgataacatatatgtatgctaccttttgtagggtaactaaaaacagtaaataactcatatatatttgaaacaaaggaaaaaatgaaaatggaaaaaactgatcaactcaaaagaaggacataaagtagaaaaaaggagcctagaaattattaataaaattgaaactaggataatagaaacacaactaaatatatcacaactcaataaatgtaattatacaaaagagttgacttaaaagacaaagattctcaggtgagactgaaaaataagtccagctatataatatataggaatatagaaagtatgcaattgaaagtatgaaaaagtggtattaatcaaatactaaagcaaagcaaggtgatatagctatgccagatataatagaatttaaggcaaaaaaacattataatggataaatattataataaaatattaaatttgtcaaaaagtatagccattttgaacttatattaatctaaaaagtggcatcaaatatataaagcaaaaatcttaagagctaaaagataacgtaaaaacccaccatcctattggactattttaacacacatggtttagtgcttgagagatcaactaaagtgaaagtatgtaaaagatatatttatatttaacttaaaagttgcaaaatatacttttaaatttttttttatttcggtaggttattgaggaacagttcgtgtttggttacatgagtaagttcttagtggcgatttgtgagattttggtgcacccatcacctgagcagtatacactgtacctcattcccttcccatcctttccctaaagtccactgtgtcattgttatgcctctacatactcatagcttagctcccacttatgagtgagaacatatgatgtttggttttccattcctgagttacttcacttagagcaatagtctccagtctcatccaggttgctgtgaatgccattaattcatttttatggctgagtagtattgcatcatgtatatataccacagtttctttattcacttgttggttgatgggcatttgggttggttctacattgttgcagttgtgaattgtgctgctataaacatgcatgtacaagtatctttttcatatgatgaattattttcctttaggtagataccctgtaatgggattgctggatcaaatagcagttctacttttagctcttaaaaaaaaatgttcacactgttttctaaagtggttgtactagtttacattcccaccagcagtgtagaagtgttccctgtttaccacatccacgccagcatctactggtttttgattttttgattatggccattctagcaggagtaaggtggtattgcattgtggttttgttttgcatttccctgatcattagtgatgttgagcagttttcatatgtttgttgaccatttgtatatcttcttttgtgggttgtctattcatgttcttagcctgctttttgatggaattgtttgtttatgtcttgctattttgtttgagttcgttgtacattctggatattagtcctttgttggatgtatagattgtgaatattttctcccacactgtgggttgtctgtttgctctgctgactgttccttttgctgtgcaaaagctctttagtttaattaagtcccagctatttttctttgtttttattgcatttgcttttgagttcttggtcgtgaaatccttgcctaagtcaatgtctagaagtgtttttccaatgctatcttccagaatttttatagtttcaggtcttagatttaagtccttgacccatcttgagttgatttttgtgtaaggtgagagaggaggatccagtttcattctcttccatgtggcttgccattcatcccagcacaacttgttgaatagggtgtcctttccccactttatgctgttgtttgctttgtcaaaggtcatttggctttaagtatttgggtttgtttctgggttctctattctgtttcattggtctatgtgcctgtttttataccactaccatgctgtttcagtgactatggccttatagtatagcttgaaatcaggtaatgtgatgcctccagatttgttctttttggttagtcttgctttgtctgtgagggctcttttttggttccatatgaattttaggatttctttttctagttatgtgaagaatgatggtagtattttgatgggaattgcattgaatttgtagatttcttttggcagtacggccattttcacaatattgagtctacccatccatgggcaaaaatgcacattttaaaagtcagttatagaacaattatgaaaattgctaacattatgattcataagacaagtctcaacaaacatattactggtggtatccttttgattaattttctctattgtttttttgttttcaaattcattgatttctccttatctctaccatttcctttctcctgcacacttgggtttattttgttctttttctaggtttttcaggtgggagcccagattactgatttgaactttttctttttctaatatatgcattaattttatcctttaaatttccctctcaacatgtttaagctgtgtcccacaaacattggcatgttgtttttgctttcatacagttccaggtgtttttcttcctatagagactttttatttgaagatagcttaattagaagtgtgttgtttagtttcaaagtttgagagagtttcttgtgtttctgctattaatttccagtttgagtccattttggtcaaagaacaaactgccagtttcaattctttttaatttgttgaaatttgattatgcctccaaatatggtctatctgatatattttatagaaattgaaaagaatatgttttctactgcttctgggtagcagaagcaatgggatctagttgtttgattatattggtaattttctttgtgctgtagtatacttttttttatattaatatagccactttggctgtcctttgattgaggtttccataatacactcatttttagcctttgaattttaacctgcctatataatttatttgaagtgagttttttgtagataacatacagatgtgttttttaatctactctgacaattgttttattgatttatttaggccatttatatttcatgtgattctcaacatattaagacaaaagcctaacattttagttttcactttctgttttttctcatttgtaaaatttctctcctttctttccctgccttcctttaggttacttggacattttttagattgccattttaatatatctatagtgattttgagtgtatctccatgcatagcttttttagtggtttctctcagggtggcatacatataagagtctttcagtgttattgttttaccatttcagggatagtataaataccttatgtttctttacatctctttgcttcctcatttttataatataattgttttaaatattttcttcacatatatttggtaccacaacagatggcattatcaattttgcttccaccataacatataatttagaaagctcaagaggagaaagaaaacctactgtatttacccatatctgtaattctttctggtgtcctgttgcttcaaaatttcttatttgatcattttatttctattttgagaactctctttagccttttcttcagggtaagtctgctggcaacaaattttgtcaagaacaagtttttctttatctgagactgtcctgatttctactcattcctaaaggttatttttgcagaatataggatacttggtaaacagttttatgtttttagcaaggatttgagaaatattttgcttttcattctggcttttgtaatttctacaataaatattttgtcattcatattgtttcttctgcaagtaagctattgtctttggctgctatcaatataaatttatctgtgtttaaatttctgaagtttaattacgatatagcttgccatgaatttatttgggtttattcttgtcaagatttactcatcttcttgcatctgtaggtttatttctcttgctaaatttggggagttttcagccattatttcctcaggtattttttagccttaccctgtctcctctctttccagtattctagtgacttaaatgtcagatattttgttataataccacaggactttcagtctttgttcatttttttcagcctattttctgtatattattcatatgcataatttttattatttcattttccagttcactgaatcttttttcttttctttttttttttttttttttttttttgagacgaagtttctctcttgtcacccaggctgtagtgcaatggcatcatctcagctcactacaacctccgcctcctgggttcaagcaattctcctgcctcagcctcccaagtagctgagattacaggcacccaccaccacgcctggctaatttttatattttttagtagagatggggtttcaccatggtggccaggctgaccctgaactcctgacctcaggtaatacacccgtctcggcctcccaaaatgctgggattacaggggtgagccatcacggaatcttttctctctcctctcctttctgttgtagatcctatctactgagcttttaatttcatttatcatattttcaagttctacaattttttattcttctttatatctcccatttcttagctgagactttttattttttgttgaagatctttaatctcccatttgtttcaagccagtttgtatgtggtgtttgactagagtataatggttattgtctaaaagttttctctcttgctaggctgcccttttcctgctcctttggctaaagagagaaggatatggaggtgaggggcttttttgtttgcactcattgacatttctgagttaccaattttacctcttccaaatgtgagttatatgcagcaaaaagaaaacccagggaaatcatcacctcatgattcctcaggtagctggatgttttgccatcttctctccactttttagagttattttgtgtttattgtatacatgatggttaaagtttttggatgtacttagcaagaggactatagaaaagcatgtctactacatcttcctgcaggtggaagtcttctctgtattttgttgagtttattcctataaacttgctactgcagatttaaaaatccatgaatgaggcacaaataaaaagttgtctgtataccactttataaactccacatgtgtttaataaaatatttaagcaatgtaggaattactctaaagcttcggggagaggccatactgtggtgtaaaaatctgaaggaggtcctcacgttcgttccaataatcactagttgtgtttcttcattgtggtaggtgtttcttcaaatctctgtaaaattagggcaaaaatactcacttcatagagtttctaaattaggattaatgagatactgtacataatgccaaccacaaaataatgatgggcaaatactaacacttcccctagctttatcagaaatggaaatagatttgtaaaaacatgagtctttattttactttaaaatatggggcttgttgaaacataggtcatagcattgtaaatatgtgtttttgtaatgttaacactttcagctaaagtgtggaatagtgattaattacatttattgcctataaaatcatcagaaaagtcattattcctataaagaaacttacaaatatggattcttcctggaagcaagaatgagggtgtggctgagatgaaagctcagggtgttgacagtgtatctccatatgaccacctgcatcagaggtcaaggacttaacacttagatccctgtcactagcagagaagccaggagacagagcatttgatagcttctgttttatttagcctctttatacacatatattctttaaaaaccttgaaaattaagaggctaatcaaactttcaaactttcctggtccttcaagaaacattccaatgtccacagagtatgagagcatgatgaaaagaaatgagtgtcccttgagagttgtttaaaagtgtttgtcccttgagatgttgaagagtaaaaacacccacataaagttgacgaagaccgtttcaccaggttaggtcacagcttttcattaatgataaatgtgaagaagaaaaaaataaaatgcaaggttacagcagaaatacttctatctttttctaacgttttcattagttctacaaccaaggacacattctactgtcagtggtttactgcaactgtcaatggtttacctttcccaggatatgaacagaaatagagtactcaagaagctgctacgtatttaatttagggtagcagaaaaaaggcaaaaagaaagataagtagttgatggtgttaacctactttaacaccatcaactgtgtgttacttaagcgtttcttgtacatgttgattttcaaatgagagtcacttatctatagcataagtactttcacacgtacaaggggtttttttctatatattattttctaaagaggaaacatttaatttcgtttccaaatgaaatatctagttcttgctgaaaatgtgtactttaaagagactttttaaaagaagaactccttgcaggtggtctctatcacaaataaacatgagaaaaggttcttagagaaacttttggcccgtaaccctgtctcctgtcgtctcatgctgggttgccatttacgtaaaaccactgtgggagtcttaaatgtcatggtagctgtgttcctgccagcttgtttgtgggattgtgtgggtcacctatcctaggggctcaactttagtgctctcaggttcattatggctccactggagagttgaaattcaatctccaatcactgttctgtaacaaattggcaagttgggcttttgctaaaatggctgccttattcctggcttaagctatttgtggactataactgcattttttaagggtgccttttgcatgggagttagaaggaagaggagttaggttttgggacaatttttggcagaggaaggatacttagaagctgaatcaaatgatgaagtcgcactctttgagatcaagcaatatccttgagcaatattgacagattgtttccttttgcctattttttgtgacattcttacctaaagcattattgtgttagtataagagaaggaatgagagtattcactccctaaatttttatggcatgatttattttatatctatatcagtgtctttagtgctgcttgaaaacaagtataaaaacccttcccttggcaagaacctgttagtaaaatgtaagattattttttaaatatgtaccaccaaaggaaatatttcaaatacttagttatgagaacctcatttcccagagttaagcaccatagcttgaaactctttatatttagttaagctaactgggttgatataagagaagcagtgattaaaataatctctcacagtgaataacccaaaagttatttttagcaggctttaggtttctctacaggatgttatgtacccaatctgcagctattgtttgagttattctaattatatttagtttaatgtacattaagaaaacacttgacttctccatgcacacactgacagacggggaggagagagcttccaaacctagtattgagctctgcagggaatttcaaaactccttgctttgagtcacttaagtgcacaaccgtcaggcaaaccatacacactagattttaatttgccttaaatcaaaggacagagaaagcccacaattggactctgtaacctgatgctgtgtaagaccttccatagggattcaaacacattagcttcaaaacggtgattttcttccctgctttcaatgattgtaacatatccatccaacaagttctcttggtcagtgtgaagacttaagcagaattgacctactttgttcttcacttcacacaaatgattgtcctttagatactaattttaaaaatattaacacaaggtccctcctctaaatccctttggccacagtttgagttcacatccatgccatctccacctgctcactgcaataccttctgtcttgctccctaccctcagccagagtcccaccctcacccccactacctccccactctcattacagagcaagatcaaaacagctccaaacccgaccaggcatttttaaagaataatgctgtttatgaaacttctttaagcaagaaataaatcctttaatggtttcccagtacctgcaaggtaaattccgaagtctttaaccacgtgcatcttgcttttcttttctccttgtgaggcacattccaccatatgtgttctacactggagttatacaaactccaattcttggcctgcccatttttaggttggaaaatcaattcagtaggtctaggccagcattatataatcaaatataataaaatagaacagaacagagcaggttatggcacacataataaagttaaccattgcttcttgatgttttgtttcagtatgtatgtggtagaagatgtaaaatgtattacctattgtgggtggacacacaaacccacacacacacggagaaaatctgtttttaacacagataatttgagtttgttggctaaaatatttagaaaatttagaatagcaataatgtttaaataaccaatatttcaccattcagaggtaacttagatatatggatttaatattgtatgtttccatacacacagctgtacacatacatgatttatatgcatagctacacaagcatttcatacacttggaaaatctcaaaatatttgttgattcaatgaataaatataaatttcatgttattaactaaaatcccattatacatacacatgattttttcctacataaagtattgtgatcagatttttatatcaatacatcttggatatacactattttatgggcatgtagtattttatttttttgatatatcaacatgtacttttattatcctataatatcggacacttcatttccaagctctccctttataaacatcattttcatatcattatataagaccaaacatgtccatatgtatgtatgtaccaatatatatgtatgtgcatatgtatacatgggcatacgtgtgtgcgtgtgtgtgtgtgtgtgtgacagagagcaccaggcatggatttaaatgccttatacatattaactcatttcattaccaaaacaacaactaaagtttctattattttcctgattttacagaggggaaaccgaggcacagagtttaaggatgttgctcagggtcacatttcagtataaatggcagagccaggatttgaaacaaaatggtctggcccaacagtctgaatatctcctactacataatgttgcttctacaacttgtgcaattaagaaaaagacttgaaagtggatttaaatttggtgaaactaaaattgaatatagatgctacttcacttgtgttggggttatgtcctgataaacccattgtaaattgaatatattgaaagtcaaaaatgcatttaatacactgaaccgaacctactgagtggtataacttatcctagcctcccttaaatgtgctcacattagacacttaaattaccctacaattaggcaaaataacctaagacaaagtttattttataataaagtattgaatatcttgtaatttattgagtgtctatactataaatgaaaaacataatggttgtataggtactcaaagtacactttctatgaatgcttgttgcttttgcccactgtaaagtcaaaaaatcccaagtcaatccatcatccttgtaaggcagaggctatctccatttttaaggcatttatttcagaggcacatcagatactgcatggcttatggaaatgctttgttctacctttagctttcattgttctgcccccacctttttcttctggaatacctttgaccatggcttgagaatagtgttcaacagcagcctctttgtaaaggtgccttgaatatgcttgtcttctcaggcagaggttaaacacctttattctgtgttcctttggctctttggacacccatttactatagcatatataatattttattataattatttgctttatgcctgtcttctccaccagagtaagaactaactcctccaaccaagaattctgccattcacctttgtactcctagtgcttacctcataattaataaatgaatgagtgaactaaagaaagaaaaaaattaattaatggctttatatttataaaaccgaatctaaaaggaaatagtgaattatattctaatggttggagcagaagtatttttaaaaatgttttatgtttgcatcacaatctttccacattactttaatcatatatgtaaaatctttctctccatctagtcatctgttatcatttggttttcataatccctgccaccacaaaacataccatactctggactccagagacaccagctccaacttttttttcagttgattcatctttaaagagtcagagtatcttgaatttgatgaatgtcagtagagcagcttgaaaataaaaatcactgcataagtgctgaatgttactattgatcattaagtatcactagacataactcaaatgattttccttattatagacatgaaagttatttttctaggcaaagaaaaggaacttattcataatattttaatctcaaatggggcattagtagtatataggatatatatactctaggatatatactggaaatctttgtcttttcctttctgttacgctttgtggatatagctttataagtacttctgtagagttaaggctatgtttctttatatcaaaattcttatacctatattacaaattttgaattataatgctacttcaatgaatttttctggaatgaaaacttccagtggattcaggatggtgtgggagaagtcctggtcacctaagtaatagggttggtcctagaaggagtggaacagacagtaacattagctcagatgtggttttctggggttggaagaagaaaaagagagactcaagattcttcttagactggtcagggccgggctgagatgtgcatacatgcccactagcaggcagggtaccattaacaagggaactccgaattgacagagcaagaagaaatggtgtggtaggcagaatattggtcccaaagatgtccatgtccgaatcactggaatgtgttgaaattttactttacatggcaaaggagaatgcatgtcacagatgaaattaagtatttagctgttctggaaattgaaagttttcctaaattatccaaaagggctcaatgtaattataaaggtctttataagtgaaagaaggagacaggtgagaaggaacagaatgatggtagcatgaggactcagcccactgtggctggctttgaagatagtggaagagggccacccatcaagagatgtggggaacttctagaagctggaaaagttaaaaaaaaggaagtctcccctatggcctccagaaggaatgcagcccttctgattccttgattttagcccattgagacctgtttcagattctggactacaaaagataataaagtaatataatattataaagtaaaaagattataaagtaataaagtaatataagttttggtaatttgctagaacactgaaatagcaacaggaaataaatacactactttttctacttattgaatgccatctatgtttttcacatgtgtatcaaattaaagattactgttacctgcttttgataaattgaaggttgactaagatagcacagctaataagtttctgaaaagtgcaactttccttttgtaaacacttgaggaagaaattgccacacctagatatgggtggggtggagaagaaagaggactaaatcatgaaacacagcatcatgcatcctatatttcttcctacattttatgataaagcttatttctgaatttaaactcattaaacagtatgcattttgactgcatgatttcagagtggtatggtcagagcataaatacactaagtcccagctctgagtttaattagttgatcattctgagtatcttcctatatctaatagggatagcatcagattagattaataaatataaaaaattgaagtgacaaatattgtcatatacatagtattactgttttgtaggctttagaatatttctttaatatatttgcctttttcgacacattgaaaattttgcgaaatcgttttcactctgccagttgatattctgagtcagtgcacaagaaaaacaaaagactttcctgagtgaatttgtgatacatagatgtccttcacatgcactttttcagttcatcaacttccataaatctgtctatttgcaatgtaatattcattcctcttttaacagaaaactttccttaagatgtgatccacagttccttatctcttaaaataaaatagacttgccgcacaacatgtagctgttttctgagatcccatattgtttgcctggcaaagtagtttacatctttattattgaattttaaggataggaaatccccatttcacttcttgagatatagggactaaaacacatataaacagaattcaagtagccttttcaaatattctggagacaattttttcacctagaagagctagttcaaggaacaacctagacaatcacacttgacattaaggaaagtactcttccactgagcatgtgcaattccacctcacctagctacataagcactaatgatcattcaggccaccagggatggtactaaaaaccaagtaacaggaaaaggaggtgatatatcagactacaactgtctgttggtcgaactgcatcacaagcattacaaatatagaattcctggatccatctcaaagtctatgttcatcctaaggcttattcacctgcctgtagacacatggaaacttctccagagtagctctgtctagcatagtggcaagtctccaggttattaggactctgtggtattacatgatgaagtaggatcatgatacaaatgctattgagctttttttcagagctctgaaaataatactctgaaattacagtttaaaatataaaactgtacttggcctaacgcatgctgatgtacatagaagttgggcttcatcaacctcaagcatgaaaagtcccttgggagttgaatagataggagagtttagagctaagaatgtgttagtggagttgaggcatatgtgaactttccagacataaaaaagactacttcaggctgggcacagtggctcatgcctgtaatcccagcactttgggaggctgagttgggcagattatttgaggccaggactttgagaacagactggccatcatggtgaaacccctggtctactaaaaatacaaaaattagccaggcatggtgactcatacctgtattcccagctgctttggaggctgaggcaggagaatcacttaaacctgggaggcagaggttgcagtgagtcaagattgcaacactgtactccagtctgggcagtagagtgagactgtctgaaaaaaaaaaaaagcctacttcagtaacccaagacttatttgaaatggcctaggaaataccaatttagctaatatgaatgatatttagagcttttaaatcacactttaaggaaagagttgattcttcatgattatgaaatatttatcacatgaattcctaggctagagactacacacaagagagtagcagtcatacaatacactttaatttattttgtgaaagtatcgtttgatcaaatgctttcttaggattctgccaatatgtgtgaccctgttttaatctttttcattgtgtctacctgtagtgaacagtggaaaaatccaagtggaatgagagtaaaaggcagctcactttccttattgtgaagttgaatctccaggggtactcactccacaagaatgagccttctttcttagctcttctttgggcagatgcttatcctatagaccagtttggtcagataccaaggaatatatttagtcacctgaagttttcatagctctttagttttatgtgtaaattaatgtttacaattaagaataagtgttatgaacaattatgaagaatgccacatgaagcattattcatcatatatgggtgtattaatccgttttcacactgctgacaaagacatactcgagacagggcaatttacaaaggaaagaggtttattggacttacagttccacgtggttgggaggcctcacaatcatggctgaaggtgaaaggcacatctcgcatggcagcagacaagagaagagagcttggggagggaaactcccatttttaaaactatcagatatcgtgaggcttattcactattacgagaacagcacaagaaagactcgcccccgtgattcaatcatctcccaccaggtccctcccataatatatgggaattatgggagctgcaagatgagatttgggtggggacacagagccaaaccatatcatttcacctctggtccctccaaatctcatcacatcttaaaaccaatcatgcctttccaacaggcagctcaaagtgagctgccttttactctcattccacttggatttttccactgttcactacaggtagacacaatgaaaaagattaaaacagggtcacacatattggcagaatcctaagaaagcatttgatcaaacgatagtttcacaaaacaaattaaagtgtattgtatgactgctactctcttgtgtgtagtctctagcctacgaattcatgtgataaatatttcataaacatgaagaatcaattctttccttaaagtgtgatgtaaaagctctaaatatattcttattagctaagttggtatttcctaggccatttcaaataagtcttgggttattgaaataggcttattttttttttttttttcagacagtctcactctactgcccagactggagtaaagtgttgcaatcttgactcactgcaacctctgcctcccaggtttaagtgattctcctgcctcagcctcccaagcagctgggactacaggcaagagccaccatgcctggctaatttttgtatttttagtagaccaggggtttcaccatgatggccagtcatgaggttggttgccgtggtcttggacagctccacctctgtggctttgcagggtacagcctccctcccagctgctttcgtgggctaatgttgagtgtctgcagcttttccaggcacacagtgcaagctgtcggtggatctaccattctggggtctggaggatggtgaccctcttctcacaactccactaggcagtaccccagtgcagactctgcatgggagcgccaaccccacatttcccttccacactgccctagcagaggatctccatgagggccccgccactgcagcaatcttctgctgggcatccaggcatttccataaatctgaaatccagacagaggttcccaaagcccatttcttagacttctgtgcacccacaggctcaaccccacatggaagctgtcaaggcttggggcttgcaccctctaaagccttgtcctgagctctatgttggctccttacaccatagctgaaacatctgggacatagggcaccaaatccctaggctgcacacagcataggaaccctgggccggcccacgaaaccactttttcttcttaggcctccaggcctgtgattggagggactgccatgaagacctctgacatgccctggagacattttccccattgtcttggggattaacattgggcttctctttacttaggcaaatttctgtagctggcttgaatttcacctcagaaaatgggattttcttttctattgcctcgtcaggctgcaaattttccaaacttctatgctctgtttccctttcaaaactgaatgcctttaacagcacccaagtcacctcttgaatgctttgctgcttagaaatttcttccatcagataccctaaatcatctctctgaagttcaaggggacaaaatgctgccagtctctttgcttaaacataacaagagtcacctttgctccagttcccaacaagttccacatctccttctgagaccaccttagcctggaccttgttgttcaaatcactatcagtatttttgtcaaagacattcaacaagtctctaggaaattccaaactttcctacatctttctgtgttcttttgagccctccaaactgttccaacctctgcctgttacctagtttcaaagtcgcttccacatgttcgggtatattttcagcaacacctcactctactggtactaatttactatattagtctgtttccacactgctgataaagacatatgtgagactgggcaatttaaaaaggaaagaggtttattggatttatagttccacatggctggggaggcctcacaatcatggcaggaggtgaatgacacatttcatttagtgggagacaagggaagagagcttgtgtagggaacctcccctttttaaaaccattagatctcatgagacttattcactatcatgagaaaagcacaggaaagacctgtccccatgattcaatcatctcccactaggttcctccaacaacgtgggaattatgggagctacaagatgagatttgggtatggacacaaagtcaaaccacatcaatgtgtcaataagaaacattgtattttaaaggcactcccatttgtctctatatacattgcttgaggatgaaataagcaagcagggacatttcttgcgttactgggagtataggtagttaatgcggggcatggctaatgattcatagacttgcaggaaatgttattttcaccttggagcctcataagaaaacacctgactctgcaggaagaattttaaaacatgccccttcctccttgccatgacatacaaaatatagacacataacattcagcccattccaacctctcttagatatacttcatatggtcaaataacactaatattttattcaataaccatactgaagactttgaagttttttacaatttgattcttaaaggtgtaatctaataaaacagttataatgactgtgaaatatttttcatgcagcacctagcatgagctagggtttcattcctcaattgcaactacaatgtttcctgtgctgtgccactcagcaaggctatttcaatggtttcttcaatatacatgaaaatcatgcctcattttaattttttggtatttttgaaccatgctttcgttatgtatatgatttggtttcttttccttcttacttccctcctctcctccttctttctttcctgccttcttttcttcctttttattaagatcctgattgcctttactttgtaactttttaatacaagatatttattttcatcctattctttatagtgtacagattcttacctactttagctttcttttagaaataattccactgttctttttttaagtgtctaagattttcaagttttattttattttgttcattctttttaagcttttaatttttaattttgtgggtacatagtaggtgtatagacttatggggtacatgtgattttatgataaaggcttgcaatgtgtgataatcacatcaagataaatggggtatccatcatctcaagcattcattcttgttgttacaaacaatctaattatacttttgtagctattttaaaatgtacaattaaattattacttacagtcaccctgttgtattatcaaatactagaccttgttcatactttctatttttgttgtactcattaacctctccacttcctccaacccctactacccttctcagcctccggaagctatcattctgctctctgtctccatgagttcaattgtttttatgtttagctccacaagtaagtgagaacatgtgaagtttgtctttctgtgcctggcttatttcacttaacataatgacctctagttctgtccatgctctggcaaatgacaggatacaaatgacaggatcttattctttttatggttaaatagtactccattgtgtatatgtgccacattttctttatcctttcatctgttaatggacagaggttgcttccaaatcttggctattgtgaatagtgctgcaataaacgtgggagtacagatatcactttgatatactgatttcctttcttttgggtataaacctataagtgagattgctggatcatatggtagctctatttttagttttttgaatttattttatttagtttattttaacaaaaataacaaaattggaggaatcacattacctgacttcaaattatactacagagctatagtaactgaaacagcgtggcactggcataaaaacagacacatagattaatggaacagcataaagaacccagaaataaattcaaaccgttctccatagtggttgtaatgatttacgtttccaccaacagtgtacagggtttcccttttctctacacccttgccagcatttgctattgcctgttttttggatataagccattttaactgaggtgagatcatatcttattgtagttttggtttgcatttctctgatgatcagtaatgttgaccacctttttatatacccgttggccatttatatgtcttctttcaagaagtaactcaaaaaccatatgatcatttcaattaatgctgaaaaggcatttgataaaattcaacatcccttcaggataaaaacctttaaaaaaaaaactgggtgtagaaggaattacctcaacaaataaaagccatatacaatggaccaacagctagtatcatactgaatagggagaaactgaaagtgtttcctctaaaacctggaactcaacaagcatgcccactttcattactgttattcagcatagtaccagaagtactaactagagcaatcagataagagaaggaaataaaaggcatcaaattgggaaggaagaagtcaaattagccttgtttgcagatgatatgattttatatttgggaaaacctaaagactccaccaaaaatataagaactgacaaacaaatttagtaaagttgcaggatacaaaatcaacatacaaaaatcagtagcatttctgtatgccaacagcaaacaatctaaaaaagaaacccagaaagtaatcccatttataatagctacaaataaaattaaatgcctaggaattaaccaaaaatgtgaaagatctcagcaataaaaactataaaacattgatgaaagaaattttaagaggacaccaaaaaatggaaagatattccatgtttatggattgaaagaatcaatattgttaaaatgtctacactacccaaggcaatccacagatctgaggtgctctctaccaaaataccaatgacatgcttcacagaaatagaaaaaacaatcttaaaatttatatgtagtcacaaaacacccagaatatccaaagctatccttaacaaaaataacaaaattggaggaatcacattacctgacttcaaattgtactacagagctatagtaactgaaacagcatggcactggcataaaaacagacacatagattaatggaacagcatagagaatccagaaataaacttatatatctaaagtgaacgaattttttgacaaagatgctaaaaccataaattggggaaaggacaatcttttcaataaatgggtcagggaaaactgagtatccatatgcagaagaatgaaactggactcatatctcttgccatatacaaacattaaatcaaaatagatttaaggcctaaatctaagacctcaaactataaaactactagaagacaacactagggaaactctccaggtcattggactgggcggatttctttaggaatatcccacaagcacaggcaaccaaaccaaaaattgacaaatgggatcacatcgagttaaaaagcttctgcacagcatagggaacaatcaacaaagtggagggacaactctcagaatgggagaaaaaaattgcaaactacccatctgacaaagggttaataaatcagaatatataaggaactcaaacatctctattaaaaaatctaataatctgatcagaaaatgagcaaaagatgcatttttctttaggtctgctgatttcaccttctctggagcatcttactgcctttagattttctttatttctctactttttttaaaactcaagttctgtaaaggtctcattcattctcttcgcttgggcatctctgcagagatcctctttcagtcctctacgcttctgccctcatctggaccgaatgctttctatttatgctacattacaatttagtgacttccttccactgcttttctgaatcacaaccactgttttctaggtgccatattcagtggtgtgcaggtaaaaatttaacataggttctcgaaacatgcatataaacaaattctaattttcagcattttctgatttccattttgcaaatattcccatcatggcagacatcaagttcccaacttaagttcactgaccatagaatggggaagggatgcctcctgccccctcaaccaaggctagcatctccccaacaccacagattagagccattttaacagagatatttctaaagaacattcatccattttctgacttaacaaagcaacttggatataatttcatcttatttggggtctctgggtcattattataaatattacagtcaagggcaaaaagtggtgtctctagagattatgacatttagagagaaaatattagccagtaaacaaaatggctaaataactaaaatggaagttagatagaataattaggtaaaaaatacaatggtgctttgtttatttttgaaggcttgttgtttttagttaccttttcaaatttataatactcaaatctagttttcacagtttgtttagttgttacagctgcccttctctgtattctcgatatgctcccttctctgtttttcatgactttttatttgtgctcttatttcttcccacctcaattcatttttttaagttctcagggaataaatattaataaatagagagagtgccttgaatataaaatgcatattttctcataagtggcattaatttggcttccctttcattacctgtgttttctttaatatcataaaagagaatgttatccatgcatctactgacagaaaagaaaatgagtttttctctttgaaagttcaccttaaagctttttgtcatgcacaactgctttaaaatagcgtgggtgtttttttgttgttttttttttggtttttttttttgtttgtttttctgaatgaatggcctgcagctgctcttcagggtttcctttttttttttttttttagtattttagttatgtttggacatttaaaaaatacatatttgtatcactgatggccctataaataaaatgctgcatagaaaagttcccaggaactaatttttagagaaaggttcctggggactaattagagtcacaagcagagacaagcaggaggttgaaaacactgtgttgcttcttatcttgctctgatattttgcgttttagccatgtctgaacatttatggattcaagagatgaatcctgaatgtatcctgaatcatatcactccatgatcaggaaatacccgtgaaatgaatgtgggtctgttgtggttttctttaggcttcgctctcttctcttttccgccaccgcttgctgaaggcaaatcttaaccaaggtaaattcagcttactggatagaggacatttctttatgtccaaggaaattaaagctattcaagcatacacctgccacataactagaaaaatacccagggagccattttcatttcaaagctgcagtttccagtgccatcagtatggctaatcactggatcattttattagaattactattttatcaatacaaaactagaaaaatgcctgaaaagtataatgatttgtgtccaaatacagcaggtgatattgtaaaatttttcaatgtagaatacaagaaatactgttagaacataataatggcatttttggtattcactggaccatatgaaatgcatctgtttcatcataaattgttgtgtatatattgacacactttataattgttttaaaatgtagatgtatgtaatacaaatataataaactctggcatgtctaaaattgtaatgacctcataatttctgtctggtattctaaaaggatgctatctaatccaagataaattttcttgtaggtatatgatctcaataaaatgtgattcaagggggttaactctagttttagatcagagtcttgagcccagagtaagtaaatgagtaagcttcgttttgaacaggtggttagtcattatcaccactggcaatcttaggaaaggaaaagaaagagacaagatttggctaacgtatatttcacacaagaaagcagggataggtagaaggttttttttgttttttgttttttttccaaaatggtactagttctagtgtcacaagcctggagttctttgtttttgatccaattatgttatactaagccaatcgttttattaaaaataatgatatgaaataagccaatcacagaaagacaaagttcacatgttctcccacttatttgtgggagcaaaaatttaaaacaattgaactcatggagatagagagtagaatgatggttaccagaggctgggaaggggagcgaggaaaagataaaatgaggatggttaataaatgcaaaaatagaggtagatagaatgaataagatctggtatttgatagcacaatggggtgactatagtcaacaataatttatcacatattttaaaacaattaaaatagtggaattggaatgttcctaacaaaaagaaaagaggaatgtttaaggtgatggatactctacttaccctgctgtgattattacatatgtatgcctatattaagacatcacatgtaccccataaatatatatacctatgatgtacccctcataattaaacataatttttaatataaaaataacaatgataaacttaaaacataaaaaatctgtctggattttctactgtagaaaatgatttaagaggtgtacctctcactctccagatagatttaaaatctaattatacttgaagttataatgcttaaaactatcttagtatattttgagagaaggtgcataaaacagcacatgaaataagaatgaaaattctaataataacggtgacaaaaagtgtgattgaagttgaatatgcagactcctccagccatgagataaagattaaaatagtatgatgatgcttggattcaatgctaatgaactttctttttttgttgtaggtctcagcattagagaggcagatctttgacttccttggtttccagtgggcgcctattcttggaaattttctacacataatagttgtcatattgggtttgtttgggaccattcagtacagacctcgatacataatggtggtaagtcttatttttatcattttgcttcatataaacaattcaaaatttctataagaatataaataaaatatttctaagtggccccttctgatataatgtggcattgcttttctagccctcaaatgttaaattttgttaagaagtgattatctgtggaaaatacaaaataatgaatgttgtacagtcagatcaaaacaacatgctcaaaagtgtatgatgacatggtgtcactcacaacgtaactgaattcaagttttacaaggaaattcaaaatagtggttggatagagtaggaggtctgcttgtagtcttggtaataggatagttagatgcaatgtacattaaccattaatttatcataactttcagtgacatttgtcactaactccaaaaaacaaatctttctagcataattgtttagtcactgaaaacaataatgtattttaattttaattgatttaggacattacaagtgcatgtatggatggatatttggtacacatccctaacatttcatactgattgatattgaatatttctctgtttgtcaagatgaatttgaaacatatatccaaaacttggtcagcacacactccattataggacagtttaatgaggtgtatgctgtgacccacaatctaatggaagttattcacagtaattagttgtcttttctataacataaaagagttcattactataggctaccatgtgagaaggttgtgagaaataataagcatatatacgtattgtaagttggagtaacatactttaaaatgttcattaagcctgaataaatatacagtgttcagtagaattactagatattttcttgggatacactgatattgcctcactagaagaaaatcatagacttaaaaacatgccatctttccattttgacataatctaattccacctgtggaaaataataaagttataatttttctctgttaatccattctctattttgatttttaaacttggcttttttatttctttcaccatttcacagagatatagataactgaatagactgcattccaatggccttgggagcatttgatagctctcaatttgctgccagggttaaacaatttctgctttactttccttctcttagaaatagcctcaaccaggtacggtggctcacatctgtagtcccagcactttgggaggctgaggcaggaggattgcttgagctcaggagttcaagagcagctagggtttttatatatatatatatatatagaaatccagtgtctacaaaaaaatacaaaaagtagccagacattggggggcctgtggtcccagctacttggggggccaaggcaggaggatcgcttgaacccaggagatcaaagctgcagtaagccatgatcatgccactccactccagcctaggcaacagagagaaaccttgtctcaaaaaaatataaaataaaataaaataaaataaaataaaataaaataaaataaaataaaataaaataaaaatacagtagcctctgctaagtaactacacaatctcctagaagggggtttcatggagttggacttgaggcctaagatgctttcataacatgcataatcaagctattatcaaattctaaatgtgttctagtttgttactatgaatatagagcagttttactcattacagactttttgttttatgatattggtattctgctgcgaaacaaaatacctggtggctttgaaaccatagatggcttccagagaatgaagctataggtaaacaccagtgacatttagtcctggtgattttaccctctaaatgttaaccgtatgcactattcacataactgctgcctttgttgaggcttatgccttctctcttctatagatagactttgcctcttattttctacctttctcccttccaatttgctctttgtacttttcttaaattactggcttaaaaccaccactgggtccttagctggataagatctaagaatattcttgcctgatgtacttgaccaaactcatatctaaccattcttccttttttccttcctttgtcccccaccttcctccctccctccatccatcccttctttccttccttcctccctccctccctccctttctcccacctatcctccctcccttccttctttacttccttccctctttccttttttccttcctccctcccacccatcctcactcccttccttctacccttcctccctcccttccttctttccttccttccctctttccttttttccttcctccctcccacctatcctccctcccttccttctatccttcctccctcccttccttctttccttccttccctctttccttttttccttcctccctcccacccatcctcactcccttctttcctccctcctttcctccctccctctctccctccctccttctgtctttccttccttctttcctttttccttccttcctttcttccttccttccttcttctttcccttcctctccccatcctctttcctttactcacttctttcttttctaactttccttctcccttttttcttctacttattaattcaagagatatttattgagcttctaccctgtgtttggccttgtgttaggtgtggactatactggtgagcaaaaacagacagacacattctctgtcttcctgggtgcttaccttacagtgcaatgaagagaggtgtgcctttatcaaacaattgtccacataaatgttaaattgcaactgcgataagtgatacgaaggagcacactagccatgagatgtctaatggggtatctgcctgtagccgggcaatggggttaggcaccctgcagggagctgagagctgaggtctgctctcagtatgagagtgagtcacgagtatgagacaagtgtgagagtgagtccacaagggaacaagggagtgaaggggggtctgggccggaggcaccacaaggtccatagaagggggactatcagagcagttctgatttactcattaagcatctattgaggacctgtactgtgctaagtttggaaaaataggaaagaattcaaatgtcagaggccctgctctgcaggcactaaccatgtaaggagtgaggaggcgcaggttctggggctctctagaggtgagtaaatggcagtgaagaggaatgagatcatcagtggggcaaggcctaggggaaggcctgagccaggtgtggagacccaggagggctgagagtctgcacacctcagtgtcatgggcctcctgctgcacctgcctcaccagcctcatgctctggtagccttgcctggtgtttgtgtcccggtctagcaatatttcctcagtctctcatggataccttcttccatacacgttaatggtgaatcactctctgctccttcacctctagagtgtcttgagtatgttttataatttgttcatgtttatgtcttctaggcaaagtgttctttgagagcatagaatgtaattagcgctcagtacatacttattgattatttttcctatctagtgtcctactagttcacagagtccacccatgatgaaactgctgtcacttctctgctggtactttttcctttgcttccctctctccctcctccctcctatgcgtagaggaaggcagttttaggtctttcagaatcttcaaagaaaagcatcaacaagaccaacaatccatgtttttgctcatcttgatggtctctttttatggattatgccaaccaagtctctctcattttatttgctatcttattcaggatcctctctcaggaaggggagagaaagaaagcaacaaatttgtgtgaaagctgtccatgcatgtcattaggtttcattctcataaatatcctacagggcatgtattagcttctctgatttcccagatgagaaaagaggtcagaaagattgagcgactagcccaaggaacacaggtggtagtgggcagcagaactgggtgtgtactggcctgtgattgttaggttcaaggagctgctagagcatgatctgtgctttgctttcactggcagattccagatgataatgttaccattgtcagtataagttgtgatataggaaacagtcttggcctacctcccagtcagatattgttacctttatgaagctccagattacgtcttattctaatatgggtataaattatctatttgataaaagtacctaaagaatcattaatctatgagtatgagaaatctgttcacaaaaattgccttttaaaaaagagcatgttgttatttgggaaggttttttttaattcattcttgagttgttgtcacaaatgctttggtttgaagctacaactggtggcctagaattaattctgatatttaaaaaaactgaaaatgaatgtggcatatgtcccattagaggcagcagcttttcaatggcagtgagaagagttctggagcagaaatccatactgacttttcactgtgaggggaaagagctttttcattgcaagagattttctctcaaaattgcttcttctatttttagtattgtcttcctttattggccaaaccaccacacagataggtcaattaaatttaatccatttcaaaataacaaacactttggagcaccaggtatgtgctaagtgctcacgcagagattaataaaatatgtatgttcactgagacaatttaatagacctctagttttacaaaaacacagataatttactgccattttggacaagagacagggttcatcacagctgagtttaagtaattgatcacctttatgaaaatgttttgggtaaaggaccatgagactcaagctcaccagtgactagcttttccaaactcttagagtctaaatcaaagcttatgaaaattgtttctttatctacttctccagcacctcctgcattccccatttgcctaccttgtgccagccacactgaatgatttgtgttttcgaaagaccacatgctgcttttgcctcttcagtttgcacatactgctccttctgcctggaatgccttaatctctctatcctcttggaaaacctttaataatcctcaattaaatagtcaccttttacaggccttgcctgaccactgaatgcaagggaaagtatctcttcccttctgctactgtaaatcctggtaactttctaccccagcaccctacccggctgtcatcattgcttcgctacctgtcttgccccattcaacaatgtgtacttctggaaggcagaactgtgcccatctattgctgtattctaagcctattcctgtgttctaggccaattcctgtatgtacagaccattagatatgcttaatacttgattgggcaaacaataaataaatcaaagtttattggatgaaaggattttacaagatggaatggacagggacttttttaaaatctcagaacatgacagcaatgtactgccttgcttatctcagcctgaacttggttgagggaattaattatatgataaaatagtatgtgctgtgctgcctgcacctaccattagctgacttactcctcaagacttatttttttctaagatgtagtgttgcgagctcctgccactataattgaggaggcctctcggcaaagactattagaaaaaccaccccaaatcacagaatcaaagatcaataattcccttccaggtaccatcacactattaaggtacaatttactatttctgtatttatttttagaatatgaaaacaactttgccacatagtactcctttactcatgaaagtattttggctaaggtgcaaggtggaatgtgtaccttagggcagccattcccaaactttttgacaccaggaactcatttcatggaagacaatttttccagaggttgggcgagttggttttgggatgaaaatgttccacctcagatcatcaggcattagttagattgtcataagtagccgcagcctagatccctcgcatgggtagttcacaatagggcttgtgttcctatgagaatctaatgccacgctgatctgacaggaggcagagcttaggcagtactggtctgtggcctggagattgggaacccctgctttaggggaatactgtgttctgtcttgcgttttgaatgggccttatgtgcttctttggctatagacagtatgaagcagtgaaatcatatttacccttcacaaagcattgttgtagaatcagttatttcctatctgtttactcctcggtcaaatatgttttattctacttctaaatttaaaaataagatttttgtcctataattacttaaatcttcattatttcatgggtgataatttaatcaagcaggttttaactcacatgcagatgaattagcaaatttgtttaacattttttgaaataagattaaccttgaaattaaaattagctcaaaactgcctttaaaaatttgtaaagggtcaagtgaatttgaaaagtccgcaatttagttatctggacttttatgcaaatgctcatgtgcaaaggacaattcattttaatctgaattgttatatagcaaaatttttctgctatgtcagcataaatcccattcttgagtcactgctcaacatgaaattgagtgttaggttttgattcaattggtaaatgtcaaacctaaattcctcttcaccagttattggctgtgaagccttgggatgtttgtttgctttccttttgccatagttacctcatttgaaaaacttgacccatgtatcattttaaataattatataacgtatatgacttgcttactatagcctaacacagagtaaatgtttgacaaatgtttgagatgttcatatgtctttttttcccctttactctactaaaaaatgttacaacaatgactgagcaagaaacttactctacatttttattataagtctagcatattgtatatgatattatagcaaattgatgtgtatatgaaagaatgaatgaatggtctttctcgtaattagaaaataagcaagctcagaaagtaaaaataattcatattataaactaattgcttgatggggaagaaatagactggaagatgtccaaagtttatttccattaaaaaatgctgaaatatccttgtaaaactaggatatatttaggaagccacatagaatgcataaacattcttttttcattattataggtcttgtctatgtggatctggatttaaaatatatatactaaacataagcaaagtagaagagagatggagagattatgcagagtgatttttttcttatattgaaaagctttctttactacaagtatatttaatatacctaaatacatgatgtaagcctgctttataataaccaaagggtatttgtttaaaaatggagagtcttattttttaaattattgcttcagttgaattataaatgaaataacccacttcaaaaagaagatagggaaggtaggcagtctctttggccattggttatcccaatgcttcctgcctagctaaatttctatggccatatttgtatctctagctatctcttttcttttatactcatgatcagatttgtgtctcaagtgcacattaaggtatacttcataccttataacaattcaaaaatcaaaaatatatattttctttgttctcagcaaagaaacacaaatttattagaagaaacttgtaatgtaaatgtactagaagatattacacaatattgctaaaacaaacaacacaagaattccatattatacatgtcacactaattgtaaaatactaaagatactgtcattctaaaataaattgccaattatagaacatatatgaataaaaatttgaggtaaactggtaatttggggaattggtcatttgacaaattgcttaatttggtgactggttatcttgccatgaatctataatccttttactaaaatcttttaaaacaaagcctaccctgtatgtttaagcatcccagctctgaaatcaaactatcaggtgtcaaatcctaactctgacactaaataggtgattaaatgattatccctctacctcggtttcagtgtgatgattgaatgacatgatatatgtaaagcacttaccacaataccaggaacacagaaagcaccaggataataacccttttattgtcaaaaacgtaggaactgacagttgaggtttacatagcctggtaattttgcctttgcaagttcagaagtagcatcaagattacaacttgtgagagatcctgaatatacttcaatcaccaagtttgtgctatgatctttaaatagatgtgttttattatgcatttgttataactatgaattgattcactaaaaaatacctgtgcatttaggaattagtcccaataattaagtcctatcatatggttttgtaattaatttagtttattgccttactttaatattgctttattttatgttcttttcctaatctttttcaatggcttttttctcttgacttagaggttagcattgctctctcatttcaatatacttataattagatttatttagaatggaagatatcaaacactagatgccatcttgctagcaagagcttcaaaacttattgaaagtttaaaatttactaagtccactcttactagaagactttatgaacagaatatattacagcatcagcaatacctgcatataccaaaaatctcactatatatttttacttatcttaactttttaacatgttttccaactaaatttccagtgatttttgagcttttactcattattataattgtattatcttaaaaatgaaagcaaacctcctttcagaaaaacaaatatatgatggaacattaaatgtaaccagttataggactatactactatatgagattattttaaaaattcataaatgacagaatacaaaatataaattgaatttcataaatagttaaaagcttctgataaagtttctattagtaacatacctatattacacagagtctaaattttataattctattgtttggcacagcatagaataagctaaataaatgatttcagtatttattttaatttaaaaacagtatgcaatgattgtaatcactgatagaaaacaataattaaattaataagtctacttaagacattaagaattcattcatttttgtgataaaataaaacgaataggcaaactgttgtatttgatatgttatttgtgttctacagtaagtactatcctcagtcatcctagctggtctgtatgtcacttttctgggcctccattagtttgtctgcataaaaaagtgactggatgagaggagccatagtccaatcattgattctccattgatgagtctctcgatctagggctaccttaattaagaccgactaatactctgggagaaggtatttcctaatacataatatcttaataaaatcaattaatcagtaagaccagtaggtttaaaatttgttggctggatatgattggaagatatgaaaatctgttattcatttcctcattcttaatcctatttattaatttctctgctttaaaatattttatatggttatatttttattatatgatcatattagaggcacacattctactaataaaatagtccaacaaacgaaagtttgttaattttgtactccacgcatgttttcttcaaacatggtcttctttcagtcctaggtttccataaatattccttaaaatgtgacagttttatactgtaacttaaagatgatagagagctcacagaagatttgcatagttgtgttccctagaaaagataatactcagaaaacagaaatcaaatcaacactttggtttaacttgtacctggaagccagcaaagcactttaaaagtaaatctaactttgttggtgtctactgaaagcagtagaaattattgaatttttaatttctggaaagcttaggggaccacatagagagcactcttttctgagcgctccgtcagtttcttcccagaagacagacttattgacatttttattattgatttatttgatatacatgcctttcatctccatatttttcttctctttctccctcccccatttctatctagtatacagtgtggactgccctctgggtcacctggaatgtgttcattatctgcttttatttggaagtaggtggactctcaaaggtgagtttatcatgcttttaaagtacactttaaaatgagtacacttctaagtattgtgactacatacatatataggtatattgtgtgtgtgtgtgtgtgtgtgtgtgtgtgtgtgtgtgtgtatagaatgataaaatactattcaaagaagactttaggtaccacttaggaaagaatgatcttaggagtgtgttaatatcatggaacttcaaaacaactgccttctggtttagtttgttatactgaagtgggactgaacttacagtgtatcctcatgtccattttaaaaagacataataccatagtgactgcaggcctaaatattaagtagaaaatggttttgaacatgcttgtgtttaaagtaggaaaagggattgatgaagatgttaacgtaacagacatgaatggcaagtttctatctttgctggaatattaattctggaaaaaattgaccaagaacaaaactcttatattaaatgtttactaagaagtaaatgcatcagcgtggtgattcctattttgaaattttaatcacacagaagacagttgtcttaatgcagcaatgatacacacgttatttctgcctgtctagaactgtcagcaaagcacatgattttattatgcctcctgcaaaaatgtctcaccacccaaatgtaagaacaacttaagtttctagttgtgtttcttaaacagtttttgtgtgaaccagcacaattttcactatagagaagaaacttaacagtattacaaaaagtataagaaagctgtcatattttaaaacttctcattatcaaatatatttatactaacttattctactgctttataacagtctcagattttctaagtaatgcacctgtggcttagattttagaaaatgtgtcttgagcagcaaggatactttaagaattcttaggttccattgaagtccttgtggtaacaaaacatgtttgattcagccaagcagcaaaaatccctgaaggatttttccagagcctccagaggtggttactcttttttctccactataataactgtaattagaacttgtcaccatttgctcacattggcaactgtattcaggaaccagaagcaacgtttccaatattgagttcagtatatttggactaacatctcacttaaataattgtgctagcgattgtagttcaccactaatttctaagatataaaaaagtaattaaattaatgtctagttatattctataaattcagattatgaagtaattttcaaatgcaaatcttatgaataaaataattgcaaataatatattaagcacaacattttcaactcactgcattttgtatcttgcgatttggatggtcattttaatcatattttttatttcactgggtagaaattattttttcttctatatacactaatttgggataaattagaccagagaaatttgtcctatggaattggcttcatagtattttgaaagaaggctgaattttgaatcataagtcttgagtccaaatctggtcttcagcacttattaactgtgaactctgaggcaaatcctttggctccatggagtctctatgaaaaataataagaccagattttccaataataatagtagtcagtgtttattatacacatgatatgtggtaactcaggtaagctttgaaacaaatctatgaagtaataaaacaaataaataagtatcagcagtcatttttttcatataactctgatttcccactgctattcaaggttatttttgtgaatttttgtaactgcttttctaatatccatgtgcatgtctaaaagtttttatctcatttctttggggacaaggttgaaaacatggacatagtagtcctggttactcattttattacctatttaaatgccattaagcagtcaaccaagtattctaggtcattaaaaagatagatgactccaaaaggagcatcctaaagattttctgttggtctcctatttactgcctcaaagactggtaacatctcccttgttagtcacagtttagcctcaattccagtctatgggaaatctattttggaaaataaagcaaagttaaggacccttgacaaacacaaataccagccacttttccaggttcgttccattgtgtaggaaactcctcgtccatatgagttggtttatatactaactttctagattctccatctcctgctagttcatgaagatacttcttggaattatccatttggatagattaatagaaacctccctatgctgtcaatttggtccaaaatatacattctgggatagtgaatctttctttaaaaatggggtccagagtgatttccacaacctctctgtggattggggtgttattccaatgacagacatggcctatgaatagcacatttgtacgctaaggtgttcttttgctgacaatttgcattcatggagtgacagcaatcctgtcttacctgaaagatagtgagctgtctcatgggcaggaaagcctggaaactgagattcttacaatgctgggcaggctgacagtgctgcatactcttgtgttttaaaaagatcattttaatttctagtaaggtaaatactgatagatgtaatccacataagcaaaagctgtttaggatcctcattaacatttaagactatagaaagaaactgaggacaaaaagcttgagaaccactcccatagagtaaccaatataactaaataactaattaactaactaaataaaaataatgcaaacagtaagaaaccaaagcagatgttacaaataaaaaacaaataacgatatggtagattaaaacacaaccatgtcaatgactatatgaaatgtaaatagaccaagcactccagttaaagacagagattagaacaatggatttttaaaatgacaatagttaatgttatttatatgaaatacacattaaacataaatacatacatatatttaaattaaaaagatggaaaatatatgctatgtaaacgataatcagaagaaaacctctgtggtcatattaatgtcagaaaaaaagtagacttcaaataaagagtatgaatagagataaacagatgttttacaatgataacaggatcaatgtattaaatagacaaaataattcaaaactacaccaaataactgaattttagaatacatgaggtaaaaactggcaatattaaagggggaaattgacaaatccattaacatagggggagagtttaatactcctttcttgcttatttagagaaaaagtagacacaattcagtacaaaataaaatatttgaacaacacaaagtcaaacaatgtgtctgtcatatagaggatattaccttaaaattacaatttatattttctattcatgtgcatatgaacaatgaccaagatggcattctgggccataagcaagtctcagtaaatgttgaatgactgaaataatacagataatattctcccaccacaaatacaagagtaatttataattgttaataattcacaaatcaaagaagaaatttagaggaaaattgaaaaataaaagtacaaaattaaagtacataattaaaaaaaaatcttctttgtggatgaattcctatcagtgtttagaggaagaaatgtagatttaagttgcttattagaaaaaaagaaaagttaaaaatcagtgatatacacttccatcttaagaagagcaatttgactaatatctcatagttggttctttgaaaagattaataaactaacaagcatgtagtaaggttgatccaaaaaaagaagaaacaatacaaattatcaattcattaaagaaagaagtgacataactacagattcaacagaaattaaaagattaatagaaaaaaattaaacaatcaaaaatattgatagccatgaatttataattaaaaatctttctacaaaaaaatcaaaacagaaacaaccggtatgcaattggttaaggaaacagaattttctgtttaaaaattttggggttagtagaaaaatgtcaccttgctagagggagtaactttctgcaagcctctcaggtaaaaacttagaacaaaaggcaatagttaaagtttagtcttcacttcccccaaatctgggctctgtgtactagcagatctgttaggtggggatcctcagtgggggtctgttcagatgttgtctttaatttctatagggaaagcaaacatccctggagctttaactcccttggctattgttaagactactattaccttcttgtttagcaagttacttaattacctctggggctagccagatgcctggaatttctctttaaaaaaactttggggtttttctttatttccctgcttggagttttgcaggacttcaaaaaaaaggtcagggtggaggtccttgctcaggatcaatctatcaaacataagaaatacataatgctaatcttactcaaactcctacagaaaatagaggaggagggaccatttcacaaataatttggtgagctaacataatcctgataccaccttatagacaagaattaaattgacatctatgttttagcagtccttggccatctctccaggaaattcctcattagccattctgccaagagggactccacacggtgaattgtttgtcaccacctgatcttcccttctcttcactcccaggctctttgctaagatcaaaattcttgctcctttatagatcaaatcaaatcagctctacctttttgtttccctcactaatccaagctatttccagacatcctcactttccttatctacaaaggcccaaccaaatgttttccttaaaaatgagctctctgtcctgcagatgagaaatgtcactctgtcacatggcagaagcatctatagtcagattgtatttaaagacttttttaattccccattacatttcactacattttgaagtggtagttgttatcaatcttaatagtttgttctactggaaatagacaatgactttagattttgttttctttctttcttttccttccttccttccttcctcccttcctttcttccctcccttccttccttcattcctttcctttcctttcctttcccttcttcttttttgtcaacagggtaagggttctttttggttagagttcttttctcataataaaaaatatatattacatatataagttgcagaaactagaaagacaagaagaaacaccatttttgcttcaaacatttgaagaccactgccgtgaatattttgattccagtttattctcattctgctgtgtttccatggtttttctctcctgtttttcttattattgttgagataatactatagagaaaattgacatactgactttttaaaaattggacttaatgaaaaacatttttatgttgttactaaagtcatggttaatatttttaaattttgtgtaatattacatcaatcatgaatagttattttttctgctctttctttaacaggagatgttaaacgcttctgatacattttgctgaatttcttctccaaaaagcataccattagctgtaaaatatgagtatctagagtgtcattagcacaagttaatctgtttcaccatttggggttttttggggctattttctttttttttttttttttttgcagttgcaagatttaatagagtgaaatagagtgaaaacagagctcccatacaaagggaggggacccaaagggggttgccattgccagctccaatacctgggtttatatcccgatccttgtccctcccactgtgctctcaggcaatagatgattggctatttctttacctcctgtttttgcctaattagcattttagtgagctctctgattggtcgggtgtgagctaagttgcaagccccgtttttaaaggtggatgtggtcaccttcccagctaggcttagggattcttagttggcctaggaaattgttggggacgttggccgacaacaactctaactgcttcctgttgaattggggtgtagtaggggttgtgcagttgagatttcctcgggaggggtgccttcgatgtcattaacatcggagcatgggctagcaggcctgtccaggggtctatggtagctcttagtcatggactgcatctggagctccatttgaagaacgatttgtagttttacagctttgactctgaaagagacaaacttaacaaggaggttaaagatacaaggattgaaatgtatggcctgcagtgcaggggattacttgtttggcacactttacaggccctgactatatgcttgatagttttgaaaaggcctgatccagtaaataataatttggccatctgatgggtactatcaatgcctaagtgaaaggtttggtgaagggttttaagtaatttccattggttagctgcaggcaaaagtattttttcttcttcggtggctagccatcctgaggggaggaaactatgtcttcgtgagtttcctcattctatttcttcttctgagtactggggctttgtttcctggaggtgattactccatactaggggtccttctataagcatttctaatggagggtcctgccttgcagctcttttggcttcaatatccactgggcagttcctttctatttccctttcctttcctttctggtgaccctggcagtgtaagactgccacctttttaggtttctgtacagccaatagtaatctcctaatggcttcctgatgtttgacaggtgttccctcggaagttaggaattccctttctctccatattgctgcatgggcatggaggacgatgtaagcatacttagagtctgtatatatatttacccttttctctacccctaattctagtgcccaagtgagggctattagttctgccagctgagcactagttcctagagtgaggggattactttcaagtattccgttatcaccgaccactgcataccccacttttcaaagtcctttttctacaaaggaacttccatcagtatacaagttgaggtctggatcagtcaagggaacctctaaaaggtcccctcgaacagcataggtttgagcaattacttgttgacagttatgttctatcttttcttcattgtctgcaagaaatgtgactgggttaagagttgcacaagtgcacagttacagcactggcccttcaagtaatggagcctgatatttaagtaaatggttgtctgacagccacaagtcttctttagcagtgagtatgccgttcacatcatgagatgtccacacagtaagatctcttccctgtattattttaactgcttctgatactaagactgctactgctgccactacccataaacaatgagaacaaccctttgccactacatcagtttccttactcaggtatgccacgggttgcaagctggtccctcggacctgtgaaaggactcctagagctattcctgtttcttctgtgacatataaagaaaagtcttgccccgttggcaagcttaccactggggcttgggttagggccttctttagggcctggaaagccgcttctgcttcatgtgtccatcttactaaatgggtatcggctttctgagtttccttaattagtgtgtataatagcctggctatttcgcttttcatggtgaaaagaaaattcttatttctttgtttaaagaataatttttttatttcttcaaagttgaatatctcctaatgtgtttgatagtcggcttttattttcactttttgttaatagggtttgtctttttgtgttttagtgatgatgtttttaggctttagtctctatggaacataattttgttctatttttcaaggtgaaaatctgaataggtattttttaccaataactgaccaatggcaaaaacaaaatttacttagtaggcttttcactggttttgcttttttatgatataatacatttctataagatctatttctagaatatcatcattttcggcacatactactttatattagtttgtatatactttataataggaattatctctctgcaatccagtcttcccaagtctatgacttaacctcatacatttggtttacagatgattttagaataaatctgttcaaatatatataatgtatattatatatctcattttagttttgtttttgttcattatgtttaacttttaatttaggaaagattgagaaaaatttatgttagagaattcaggaggaaagttttgagtaacagaatcaatcacagaggatgtgaactaaaagttccaacgtcaaactccttatgaactagtcatcacggattgtgttaatattcttgggtatcacttgacaaaaattattttttcagtttccttactccttagtttagcaaggtacaagttcttgatccatgaccaagaagtataaggcatgcagacaccggagagtgagtaaggcagagtaggattcattaagcaacagaaaagctctcaacagcaagaggggaaccgaaagtggattgccagaaatggggctgagtttgggtcttttatgtggcagaaacaaggtagtcttctgtgtgttctgccttaatgagagaagtaaagctgccccctgtgggtgttgcatctgtgtatgcctaaggttggccagagtgactccatgttgattattactcatgagtgcctaagcgaaacccatagagggagggtggggacataactccaatgttaatgatattacaattggctctgggtcaagttaaggacatttagtggatttattttgccttcacctaagttgggacagtcccttctgagcagacatcctggtataagaggaagttcttaaccacgtttccaccctgctacataggggcagtgcagatgcattcccgcgggttctgtctctctccttagaccctccctctgtgtctgcctagccagcctctaactgtctcctctctctaattcatgtcccttctaattcacgtagaagggacactgtgttggagggacaacagaggtcagagaagtaggaggcaggaggactgggtttggaacagctaggagcttaggtagacactggaggctcagaggaatgactgtcttgtcagaaaggcacagctgagatgcaaacaggatccagctgttgtccacctgctcactatttaaattactagggtgtgatggagggtgtaatgatcccagctggatcaacatctgcctctttgccacaggaagacagggttcaagattagaggtctcactgattccataagctgggaaaaaactaatttcaatacaaaacaaaatggggtagtctcaagaaaagagagacaaccatggccaccacagagcatgtcttaatcattcttatcaactagtaatgtatattctcatgggcataaacaattatgcctcttgcatattatgggagtcttgatcacagcctccagatattccctttccttttgtctcatctgccagcctgccctgcagcaggcatttgttaccgcaggcttgagtgttttagttctccccatgcctttcagcacttgaaggtaatggatgccttgttttaaggaatgtgtatatgtatggtggggtggggaatgactgtgggtaggtaactaaaagtgtctgtctatacttgggtaatctcctgaagcctcaatttcctgttctgcaaaatgaagaaagccacaacaataatcgcactgggttgtggaaagaattaaataatacctatgcagggcttagaaatgatcttggcatattgtgaggtttcagtaaatggtggttctcattattaccttcaacatcatcatctttattattattggagaaattaacagacatcacaatcctcatcctgaaaacctttgggatgtatttattactatgcaagagctgtaaaagggaagaattgtaggactgagtgactcgtttaaaaatatgaaagagtcccttgtgataggacctcagatctgcattttaacttcacagctgtaacagtattaattaaatcatttccttcaacatgtaaatagctttttgacatacatctgcagccagattctcctggtgtccctaccacttcccctaggagtactttaagcatctttggaagtctccaaggctgtttttcttgccacactttaagatcatcaagggcacaattaataagttattgctgcttgtttggaagttacaagacttgaaataattttttcctcctgaggaatacatttggaattaaatatgaaaacccatcttatttgctacacttaaagataaagaacccaagttttaatacttttattccaaagaaattagtccaatctgtcttaatggcatcttttaattattttacatttaaaataatttaaaaatttctaggtacattttacctagaaaatttaggttaatatttctcctaattgacttatcttgaaaggtttggtacttacatattagtagtcttagagaattttcaatgtgtcacattttcatagaattctgaacctgtacaactgtgcataagcataactttgacataaaaatgaatgaaagacattctacaaggacttattttatattaatcatgagctttgatcaggggccttctaaaatcttataggcaggggacaggggaggaaaatggactaactcttactggtttcctacacagcacaggggcttcccatcagtttttttccattttaaccctacctcagaggtagacattagtatctttattttataaatgaggaacctcatccaggagaggctaacttgctcaaggcacatagcagtaaactgagatgtcaggtcttaatgcttccttccgaaggtcacttcatttcccattatagcaagttgcttcctacacagaaggaaaacccacctgcatttgtttctctatgacatgttttaacagctatgctttttctaacttgtgggcattttgattcttggagaaatttaagccatttcctcagaaggcaataatagcaccttattgtcctcttttgacttaaattttttgacttaaattgacaccatcattcatgagggtcctctttttaaatctttagttgaatagttcacctgagcagccaggcagcatcagtgaaatagttcttcctcttcaaggctcattcttattacttaccttgaattgttcctttgcacttactgggaaaattttttgtcttgatcaagattcattttccttcaaggttggattcttctatcaactttagcttttgggcaggcaatttccagtaaaatattttagaccgtcaattcagagttcagtacatgaacaattgcagaggaaacagaactctcagtttccctcagctgcttacaatctatccattgtcttttataaacattcaaatatttttgcatctcatagagttctttttctgatggtagtttgaaattaaatcaaggatatatagcatctttccttttttatttaaacaaatacaacctactgaatctagtaaagtttttaagtcatatttatattttctttttgatatcttcctacctggacatttttcaaaatgaatcctaaaatgtgatgtttaaagaggaatggaggtagggtacagaatatctatattcagaaatagtatatctggcaaattgtacagaaatagcatcctagaatcacagccaaactatgcccacttctggaactacaagaataatatcctatgcactattctgtatcctgaagtaaatggatctatctatatcaatggacactttgggaaagatacatattcatttcactagaataacaaaatatttcaggttctgaactaacatattagtaggtatgtatcctgctgagctaaaggaatatttttgtctataatattgactgatggtggtggtagtggctgtgagtatctgcccacttattaaggatctgtaaagggagaatcatcacaatctgcttccaggtactaaatctaaatgagaacaaaagcctgaaaatgtttattgttatgtttggttcctgcacaatctttatccaaagagacgcaattatattcttttaaaaaatagcaaggaaatgtaaatataggtgtgagtttcctattccaaaaatttaagctacgtcttttcctttggcatgagtctaagtgaacataacttctaaaaatacagtcctcagtttcttttttatagtgagataatttgattcctcctgtagcttttctacaataaagaaaatcacaagcaaggttaagctcagtcttatatttttcataaatttcatcaaatacaaatacctcaaaaatctttatcctaaaaagccaatttgaagctacattataagccaacgacatatataaaacacaatctaaactaccaagtaattgccacaacctgggtagtattaagagtttttaatcagaaatttgtattgtaatcttatgcctttccataagggttcaaatcgtttttaccaaggagtagatgaatatattattctatcaacagtagctgtatttcttattatatgattagaatcacttattgaacaaagcctatgcaaatataattgaaacactatccagaaatatgttgtctttgctctttgtattttatcttttcttcttctaatgaaaacacacctgagatcaatatttaaagataaacattttacctttgtatctagtttattgactcaactcatgggataataatcatgaaatggttttatttctttgaataaactgcttccccaatcttctgccccaaaccctctttctgtttcataaaacattgtatacagagtctatgacaacattggtcataaaaagcttgtttcatgtctgattcacatctattctttccccttaccaaagctgaccttgttttaggccttgacctctccctgatcccaactctactctgggacaagaaacaggaggtagtgggtcttcttacataaccagtcttaagattatgctggagggtttgaaggatcctgatctcataatgatgttggtctgttccagctactgctagtggcctctgctgatgaatctccaaacatggcaaattcttccactaacttcaataagtcaatatttatttttaatgagtctataattattctaatacatgaaaatttgttaacatttcagaacattacatagcattaagccattctgagtagactccaactgctgagctgaattttcacgtaagcatcattatcaagagaattttggtgctgtgaagaaaccacacttttatagcttatattcaaatgcttttctgtgtttttgaagacaatttaaaactactgctgcagaatttttcatgcagtcgattgaagataagatcattgtagaagaacaatacgtagaaccattattcttataagtgacattaagatttggattttcttgtgatgttgatttgcttcgaatgcaaaatcttagtgttgtgacatgtcaattaagagtacagtcttgatgatgaagaatttctggtgacatttgcaacaattaacaaattataaaagagaccctgataaacacgttttgtgacatttatttagtttttaaaaccagaatagcagtgtgtactactggatagccttataaaataaaactgcaccacatggtgagattatgattgatgagtattaagctgaagtgccctgcaggagcagaggagcctcagataacaattactcaatgctactcccacgtatgttacagaggcaaaacttaagtcatttaaattcttcggataaaatttttccatgtagacagttgaaggaaaaaaaacacagataatattaatcatttctaaacagttatttttgcacagagaaagtttgtctctgagccccatgctataatggcatgaggaattataggctgaggcttcagattgaacttaattagtgtcttgcacacatatggccctggaagcatctgtgcatctgatttgtgcttcctctggttgtggttgtcactgcaactttgatattgtaccagctaccttagcataggagtcaggatccctgactcaggaaggataagtttgagaatgcaaggtagagagaattctgagaagattaaatcaaatatatgaagaaatatgtgaaaaatgattggtcagattagtgtcaaagctgagagaggtggaaagagagaaaggttttgttttatctgcaggaagccactaacagaatgacagtttctgcagaaacccttgtaacaagataccctttggtatgaagttcctaacaagccagtgtctgccgcacagcagggctgcctggaatgtctgctgcggcacagaactgcccaaggaagagagtcaggaaacaggagagattccatccttccatgtcccatctgaggactaatagaaaatagtgagaaagttactagagtgaagattgtccagaagatgaggcagaactggctggtcccagtagaggccactgaatggaggcaacaaggtgacagaattaaaaaagaggaagaatccgagtgtctgataacaagaatgagctagaatcgcctttgccctttggaagccctcagcattgattcacttttgcctgctttctgattcaggaataacagtaggacaggaaaaatacagtacacagctgtgtgtgtagtaattgtcggtgtgcttgcatgttaaaatcagtatattgaaacatccagctgtctatgctcacttaaaggctagtttttgtctgaaactttcatcccactacagaaaccagatggaatatctcacaatcaaataacagatgaagctgaaaaacaataaaagcatgtaacacataattctactttattcttgtaggagccactttaactcaaggctctgagaacttatttatggaacccaaatattagtaactcgtaattttctaaaagaatagaaatttaaaagcatacatttctaggattagaattggatggggaaggacaaaagttaattgaaatttagcaaacttcaaagaaaaagaaagaatatccatttgttaaattaatttacaaatgggaagtatagctttctgtaaaaatcatatcattttccaaattttctaagtgttcaactatattcatcaaatcattctttcattaaacaaatgatggcagaagtttctggttatcgtccataatctattcccgcttcttctggtcaagagtctaggaaaatcctgctctcgtcacaggtggcagggctaaaaagctctatttctttgtctctgtaggtgtaggtatggtcatctaagtaagttctggccattgtgatacatgcagaaggattgtgaggaacttctggaagggctgctgtagagctaatgaattagaagctgacccaaacttagtgacttaaagaatacaaatatgttcttgcatttcttctgtgggtcagaagtctcatgtaggtcttaatgacacctcaaaatcgaggtgtaagaaggggctgtattcctttttggaggttctaatgtgaccttgaggatgtcaaccatgcattagaatggtagagctgaaaacaaaatgagcctaataactcaacggagctttcagaccagccctgagctgcccatgaccggatttgttttacattagaaaatgtgttcaagccattgtctgagggtctgaaatatgcaactgaaaaccgtgcctatatcattctatagtctattttatctagtatttactcggttcaaagcactataccaggaactagggctacattcagttgttgcccccataaagtatttagtatacagtctgccctctgaatctacaggttccacatccatgcattcaaccaactgcagatcaaaactatttggaagaaagcaataaaaagtaacaatacagaaataaaaaataataccaaatttaaaatgtagcgtatctatttacatagtatttacactatattaagtattacaagtattctagagattacaaagtatatggagggtgtgcacaggtcatgtgcaaatactatattattttatttcagggatttgagcaccctcagattttggtgtctgcagggggcctggaatcaatgccccgtggatactgaggaacaattgtaatagaaacaaattttctattaaatgagtattcacaataaaatgtagtgagaattatgataatggaaggaaaacaaactttggtattttaaagcagggaacacagttttcctaaggaagagggaattaagagcaaagaacattatagcaaataacatgctgatcttcacagatatgctgtaattgacctaccttcagtgagaaaagtgcttttcgttgccactcttaaaaattccttataataaatgtgcgtcgatccaccatctccatcttaccctcttttctcagattgtcctttggcaagcacatattaaagagagaacctccaaggattacatggatcaggactaaggtcactacccttgagaggtgatcctgtagggtcatgctctaaacaagggaggtatcgagttacagattgtaacaatcagtggcctgaaaatatctgttcaggcacagttcgggaaaaaatgctagtctactagtgttccttttgaggttatctgtaattttcctaagcataaatagacaaatgtgctcctcaactctaagaccatttcagtgcacaactgcactatttagcttagagtcaatactgattcaaaaagtatttcaaggaagggtaaatacacttcctgcaaaatccccttaagaaagtatgctgctggaaaaaaaatggcataaagaagtcctttcagaacaagcactatatccccacacttattttagccacagaaattcaatttggttgagttgtctggggacttgatttgaccctgtttccagaacaatgtgcaatggcttgacagaatcatttttaaatgggccatctgatgtttcagtttgtagatataattcatcatttatttttgtcctgtaattatagaattaatgaagaaaacacttcctctgtgtatttgaaatattaagggcatcaagtcattttaagtattagtttgagaagatactctgtcctgcttcaaggcagcataggacatcagaagcagtgattgtgtagtgagctgtgctcatcattagctgagatactgagacagtgggtgtagttatttcctacatacaattaatgctgcatgccaagagcattatattaattttggttcagtataaaatgcaggcaggctactgatccctgaaatcaatgactgtcagaagagcctagacattgggcattgggtgatcacatgaataattgaagactgatttgttaaccatgtagaaatgaagttagccatacagggagacaccttatcaattgccagcaatttgctgtcttttttgaaaaccacaggcaacaatttacagaaaagattaggccagttattgtacacatgtgacatattcttgatttaaaatgtcaatctggaaagctgtaaactgacacctggattttggaatgaggttataaagtttatgaagaactgattttcccagagaccgtctatatttctgctgtggaagatccctgaatgcacaccccctgctggggccaactatgtgtgtacaaatgggcactgtcatggaaggctgatgcaccttctcttgggaccattcagcacctttgcatcactcagtgcttgaatgcacttggtgttcatgacagtatggtgatgagcttttatttcttggagaaaaaaatgttgtctatatatttcttcttcctgtgcaatcctgagggttataatcactttcatcctgcaccaggaatttacatttcagtacttcataagaaaatgattaaagggaaatccactttttattagtgtaatttctttccacttctttttcctattggtattaagtcagtaacaatcattttttttcacatttgaatttgtgaaaaggtgaaatgaaggtagccttggcccccagagaaatttgaaaccaatatagtatcctgaaggatgactgctattgaaagaatatttataaaatactgtgtctcatatttaaacaccatgaagtataacctatgagtgatcattttctgaatgttaccaaaaataggctttttgtatacgttgaaatgtattctcaatatttacattaatttattaacttttccaaggattcctagcaagcataatcttgcaaatctaattttgttattcctaatctgaaatcacatatgccaatgtaactatttaaaaaaattgtgttaaacttttaatatgagaaacaaatcaagactccttatgtgtgtcattgttagcaataaaataaatctaaaaactaagacatatactttctttcttcttcttttcaccctttctatatttgcccacctggctgagtctataagctcctttataaagtgatggcaattcttgtattttgctttaatcattctttcccacacttttctttttcctaaaaggagaaaaacattgataaattggttttggtttcctgtgtcacgtattaaaggtgaaacctgaagatgctaaaaattgatcataaaagccaaaatttgaactgtttaataatagagattagtattagaccatagctctggttttgcccaaatgtttgtggggctttctcaattaaagaaatcaataaaataaaaatgtacatgaatggactaattttaaaactttatgttgaaaactggcacagctctgaagtggctcagcaggcttccctcgcttggccgtctatggcaaacgatactcttgccactcttggcaaacatgcattattttacatgagagtttgggaagcatagatttggaatggaaatggaaatcacattcaacttttccaagatactctcttttatgcaacaagcaagcatctgcaattatagcatgtaaactttaacttccttaaactttcttatagaagtcacaaatatttttataattattacagaaagaaagttttaaattatttatacagtcttggctttggggggatctaatcaatgaaatcatatagttttattgtccattcattgtctatagcatttttaatataaattaagatacactttcatagggggaaaaatgtccaatgatttagaaatagctatgctatggacaataaaatcatggttttctgtgtttgagtgtttgactaaatgttagactagaatataataattgtggcagcataacagaatgttttcaacttagtaagctttgacttttgttgcaaacatcaggaaattaatctctaagtctaaactgtgataggtttacacctgagcagcctcttgctgctcaggtcaggctataatgatttcgacttgatctatttctttacctttagaaactccctactttatttttcactaaatcatcaaaaaccttgtgccctttgttacaccaaacatagagttgttttattattagtttgcatttatattgtattttccctcaagtagcttgaggtgctttacagaacatgacagcagtcatcaaaacactttgtcaggtaagtaaagtgagaaataatgctgttataaatgtgctgaaggcattgtacttgctggaaaatgtttattttctacatattttgttagatacaatcttttcagtgattttgtttaaaatgagttccaactcattaacattttcttttcttggctttagaatcagacacatttgttcaacaagtttattgggcatctgctctttgccaagtattcttgtagggactgagaatataactgggggataaaaagaatttgctctcaaagagcttttattctggggaaagagacataatatataaataaataaatatacactataattgcttgttgtattaagtgctatcaagagaaaaaaacaacaaaataaaaggaaataaaaggatagagagtaacttcatgagaatggaaggagttgagaggccttggtggcagaagagagcacaaatatgggggaatgccaagtctcccagataggaacatgtttggcatgcacaaagaactgaaaggatgccgagtcatgttgctagcacgccatgagccagtagaggagagccgaagaaagagcaatggcaagatcctacaggaacgtcgtgtaggtcataacatgatttggatttggtctcagtataatggaaacccattggatgcgactgagcataggggactgacgggatcagaaattactgtgtaggggacaagagtgaaagtaagatgacccacagagatcatggtggtccaggtaagaaacaaaggtggtggccaggtgcagtggctcatgcctataatcccagcactttgggaggccgaggcaggtggatcacctgaggtcaggagttcgagaccagcctgaccaacacagcaaaaccccatctctactaaaaatataagattatccgggcatggtggcacatgcctgtaatcccagctacttgggaggctgaggcaggagaatcatttaaacctgggaggcagaagttgcagtgagccaagatcataccattgcaccccagcctgggcaataagagcaaaactccgtctcagaaaaaaaaaaaaaaagtgcttggatgagggggtgacagtggctgaagtgagaataatgagtttgaataatcagttcaaatatccaatttcaaagcagagtagatagtagatagtagtagaggtggtgcatgagacagaggtgtgtcacagacagaatctttaattctgtctctgacacatgtgctattgtctcagaaactcaaagttttcttaccagtaaaaatgcaaaaataattacatcagagaaaactgatgaacagctgagaaaactgagaccttgtgcagagtatacttttgatgctttaaaaatgcatcctgtctcccacttctcaactagcctttttctttcttactttctattccctataacgtcacactgcttatttctcttttccttgtgtttcctactttgttgcatcatatattgtccttgccctccaaatgtcttatttccagatgccaagattctgttcattgttctctttgaatacagaaggggttggttgaaatgagccctactacgttttttactatgttcttatgtacatatagtttcatagtagaatcttagtttcatagtagaatagtgattctactgtgctcttttttggtttccataaaactcttggcataatagttgatgtacttctaatagatacatctgaaatttcagtgggggaaaaaagctaaatatgaaatacttgcttccactatcagccagacagtctttagcactgagaattaaaaagaaaatatttttgaaatttagagtcaattctacccagttatatatgttcaccttgaaattcttctaatttcttttttaaaaaaatgttatgggtatatagtagctgtatatatttatggggcacattagattatttgatacaggcatgaaatatgaaataagcacaacatggaaaatgaggtatctatctccttaagcatttatgctttgagttaaaaaaatccaattacattctttatttaacagttaaattattgactagagtcaccctattgtgctatcaagtactaaggtcttagtcattcttttaaactattgtttgtactcattaaccatccccacttccccccatcagactcccgctctggaaatcatccttctactttctatgtccatatattcaattgttttgatttttagattccatacagtgataacatgcaatgtttgtctttctgtgcctggcttatttcccttaacatgatgacctccagttctacccatgttgttgcaaataactggatctcattcttttttatggctgaatagtactccattgtgtatacgtaccacgttttaaaatctgttcatctgttgatggacacttaggttgcttcaaatcttcccacttttaaacagtggggcaacaaacataggagtgcagatatctctttgatatactcattttctttcttttgggtaaatacctaaaagtgagactgctggatcatatggtagctcaatttttagttttttgaggaacctttaaattgttctccataatggttgtactaatttacattcccaccaacagcatatgaggtttcccttttcttcacatccttgccagcatttgttattgcgtgtcttttggaaataagacattttacctgtggtgagatgatatctcattttagttttgattttcatttctctgatgatcaatgatgctaaacacctttttcataagcctgtttgccatttgtatgtcttatttgagtaatgtctattcaaatattttgcctattttttgatcagattattagattattattataaatctgtttgaattccttatatattctggtgattaatcccatcagatggatagtttgcaaatgttttctccagctttttatactgggacctatctctctctttagctctaataatatttcctttctatatctgggtgctctcacattgggtgcgtatatatttaaaattgttatatcctcttactgaaatgatccctttgtcgttacatagataccctctttgtcactccctatagtttttgtcttgaaatatattttgtctgatataagtataatgactcctgttcttttttggtttccattggcatggaatatctattttcagtctttgtgtgtctttataggtgatgtgtgtttcttgtaggcaacagatcaatgggtcttgtttttttttttaatccagtaagtcagtccatgtcttttgattaaagagtttagcccatttacattcaatgttattattgataagtaaggacttactcttgccaatttgttatttgctttttggttgttttgcggtctcttcttccttctttcttttcttcttgtcttcctctagtgaaggtaattttctctggtgacatgatttaattattttcgttttagtttttgtgtatccattgtatgttttttggtttgaggttgccatgaggcttgcaaatattgtcttataatccattattttcacgtgataacaacttaatactatttgcataaacaagcaagcaaaaagaaagctaataaaagttctataccttaccttcctatccttgctttttaactttttattatttctatttatattttattgtaattgctatgtcttgaaaagttgttgtggttattatttttgattggttcactattttgtctttctacttagaataagagtagtttacacaccacagttacagtgttatagtattctgtgtttttctgtgtacttattattaccagtgagttttgttccttcaggtgattatttattgctcattaatgttcttttctttctgattgaagtactttctttagcctttcttgtaggacaggcctggtatttatgaaatcactcagtttttgtttgtctgagaaaatatttatttttccttcatgtttgaaggatgtttgcactggatatactattctaggacaaaagttattttccttcagggctttaaatatgtcctgccactctctactagcctgtaaggttttcactgaaaagtctgctgccagacgtattggagctcctttgtatgttattcttttcttttctcttgctgcttttataatcctttctttatccttgatctttgggagtttgattattaattgccttaaagtagtcttctctggataaatctgcttggtattctgtaaccttgtacttggatattggtatctttctctatgtttgggactttctctgttattatccttttgagtaaactttctactcatgtctctttctctacttgctctttaaggccagtgacttagattttcccttttgaggccattttctagattgtttaggcatgttttattgttttttattcctttttctcttctgattgtatatgttcaattaggctgtcttcaagctcactaattattacttctgcttgatcaattctaatattaaaggaatctgatgcattctttgatataccaattgcatttttcatctccagaatttctgctttattctttttaattatttcaatcactttgttaaatttattgatagaattctgaattctttttatgcattatcttgaatttctttgagtttcctcaacacagatattttaaattctctgtctgaaaggtcatacatctctatttcttcaggattggtccctggtgcattatttagttcatttggtgaggttatatttttctggatggtgttgatgctagtagatgttcttcagtatctggccattgaggagttaggtatttatcatagtcttcattgtctgggcttatttgtagccattcttcttggggaggctttctagatatttgaaaggacttgggtattgtgatctgagctgatggcatcacaagcccagtaactctgtgtttcttgcagactcataggaatactgccttgattatcctgaatcaaatctgggagaattctcaggattttcagatactcttgttctcatcccttactttctccaaaacatacagagtctctctctctgccctgagccacctaaatttgggagtggagtggcacaagcacccctgtggccatcactactatgactttgctgggtcagacctgaagccaacacagcactgggtctcactcagggcttgctgtaaccactccctggctactgcctatgtttacttaaggccctgaggatctacaatcagcaggtggcaaaaccaactaggcctgtgagcttcccttcaaggtaacaagctcccccaggccctggatgagtccagaagtcccatctgagagtcaggaactagagtcagaaaacttacaaatctaccttgtgttctattgtattgtggctgagctggcactcaaaccacaagatatagttcttcccactcttctctcccctttccaaaggcagaggggcttcatgtcgtagccactgctaccacagacccatggggagtactgccagactacctctaatgttcccttaaaacccaaggtctcttaaatcagcttgtcatgaatgcttcctggactcacccttcaagacggtgaactcccctctggcccagggcaggtccagaaatgctatttaggagtcaattcctggaatcagggacaccaagagcctgcttggtgctctgcacccctgaggctctgctggtacctaaggtgcaagacaaagtcccctttacttttccctctgcttttctcaagcagaaggagtttcgccccatagccaccacagctggtagtgtgctgagtctcatctaaagccagcaagcctcagaggctcacctgaggcactcaaggtagtacctggtattgctgcttgttattcagagcccaacagctcttcagttagcaggtggtgaatgctgccaggactgggtcctttccttcaaggcaacagggtgtgcctaggaatgttgtctgggaggtaggacctcatgactctgcccagtgccctatcctgacgtggctgagctggtttcctagaagcaagacaaagtcctcctgaatcttgcccctcctctcctcaaacaaaaggaagggatctcttttggagtggcgagctgtgaagtgtggagttaggggaggggaggtgccagcactccttttgctgccctagctggtgtctcagtatgtcacatgacccctcggtccactgtctctgggcctagttcagcactagaactcacctaagagttgcagtccttgtggcctagactgcatttcaagtttacttgtagacacagagtgtagtagcccttagcagggaggtttgcaggcactcaaattctgacctgtggcatctgcaattcctctctggctagggctgatttagataccttcatgggcaggcatcagctgggtttggtctggttttcttttctgctctaacaagacagcactgagttcagtgacacaattgctgtgttgtcactcccccagtgcccagagctgctcttagcaccacactgctgctgctgccagggatagggaaagggtggcatctgtgattctagacttttttttaatctcttcagtgcctctttcagcaatattaagttgaagccaggtgctatgattgctcgcctgatttttgattcttatgaaggtgttttctctgtgtagatagttgttaacttggtgttcttgctgaagggatgatcggtggcgttttctattccaccatcttaccccaactctcctgaaattcttctaatttaaatgagaataggttatgtgaaaattcacatttttattgttgggaaaattctaattttgtgggtttttgcttttttttctgactctaacccattctccaataccaaatggaggtccaacaactccctttaattctgacactacctagagctagcatagaccccacaggttaagggctcagttccacaagactacgcctacatctcattccagctacaaatggggtctccagactactcacacttctgtccagccaactaaaaattcaggggttctctcgaccactcctcaggtttgataactccctaggatgactcacagagtcctggaaagcactttgctaaagattactggtttattacaaaggatacaactcaggagcagccaaacggaagaaagcccaggacaagatatgagggcgaggtttccatgccctcttgccagtgtaccacgggcagcactttgatgtgttgatgtgttgatttgttccaacccagaagcttcccaaacctcatagttcaagaggggtttttgtttgtttgttttttgttttttaagctttattacgtaggcatgcttgattaaatcatcgtccactggtgattcattcggtctccagtcccctttcccctcccacttcaggagtgaggctgaaagttccaaccctctaatcatgtggtttcttcctttagcaaccagctcccatcttgaaaagatccaacctcacggtcctcaaaggtcacctcattaaaataaactcggcaatatagtttggatgtcctctccaaatctcatggtgaaatgtaatccccaatgttgtagttggggcctactgggaggtgtttgggtcatgagggatttctcataaatggtttagcaccatcacattggtgatgtcctgatgatagtgaatgatttattgggagatctggttgtttaaaagtgtgtggcaccttctccctctctctcccttgttcttgctcctggcatgtgatgcacctgctccacttttctttctgtcatgagtaaaagctccctgaggcatcctcagaagctgagtaaatgcaagtgccatgcttctacagcctgcagaactgtgagccaattaaacctattatctttgtaaattacccagtctcagatatttctttatagcaatgcaagaatggcctaacacactcagataaggtcaaaaggagctccttattaatgataaaagacactcccattacccaggaaatcccaaggcttagaagctctgccaagaatgggcacagatatgtacgtttttattagaccacactaatcatgcaatctttaattactaacccattgagaaaagagctcttggaaggactctgacactaggtcataaagttaaaccagaatgagaaagatactgaatataagtgcaaagaacttgaagccaagtaaaaagaaacaaaggcaacagcttgaaggactgctgggtaccaggcaaatttactcagggagcttgtttcctcctaacatcagtctcccaaagagtgccctttctcctgttgcatagaaagatgaaagcctatagaaagtaaataatttaatcctggtcagccaaatgatatctggaaaatgttgtgcttaatcctgagctgctcactccaagattaagattatagtcattattgacagcttcctctggtatgtaagagaaacaccaaatggaaaaaaagaaaatgggaaaacatattactgtgttcataccttcttgtcctcccccaggagaagtgttctgtcttatctaggcagagggaaggctaagacatgagagatttatgactaaacaatactctctttgagtagttgacaccagaactacataatacaaagtgataggaagacttagcatagtaattctgtgaattcaagcatcaaagactgtaaaccaacattcatatggctttcgtctggaattattcgaaagattatattctcacggttctgtcattaggatctaaaatgttggccattccacgtgctgcattccttggtgatctttatcatgacatctgccaagggaccttgcagatcgtcatagctcaactcacattccccatttagtccttcatggcaccattcatctcgtctgcagttgaggaaatcctatttctgagaaattaaaatctctagtgaagacacacaaaatgagtggctaaagtgagagtcaaatttggaacaccagaacccacatccatggatgttttccgggatgtgattcaggtttggggttggaagcatttaattgacttatcaggatccaaaacttcatgagtcgatccagcagggagtgaagggaggaagtggaatcacaaagtcaagccagttcaaagcagctgtctcatcctgctgtgtctcaaaactgctgtagtccctcatgattgcttcgctcgctcgtggtggacaattagttgtggtggcttttttttttcttttcccatgtgtttatttgttttgcattgctttcccctccactaaaagaaacaagaagaaagaagaaagaaagaaagaaggccaggggctgtggctaacgcctgtaatcctagcactttgggaggccgaagcaggcagatcacctgaggtcaggagttcaagccaagcctggccaacttggtgaaaacctgtctctcctaaaaatgcaaaaattagccgggcatggtggtgggcatctataatcccagctactccagaagctgaggcaggaggattgcttgaacccaggaggcagaggttgcagtgagctgagatcgcgccacggcaccccagcctgggcgacagagtgagactccatctcaaaaaaaacaaaagaaaagaaaagaaaagaaaaggggaaatggaaggggaaagtgaagagaaagagaagagatacctacaattgtttccaccatggtgctgttgggttaagcattctaatttggtggtaatggtgttcagaggcctcagattccaacttggagaaatcggatcctaatgtaaccagtgcagtgtaacaggtgatttcgtgtaaagatgcaatcacctgctttcatctgtgaaaacactgtggtggctaggactacaagctcattggtacctaccttagctaagttgaacttgacaatcccatactgggtcacttaccttaagaaggggctggcctcttctgttttgaaattcaggaaaatgtgaccagcatttaatatcaacacagaccttaagtctgataagaaatatttacagtctattctctctgaagcctgttacctggaagcttcatctgcatgataaaacttttgtctccacaacctctaatcataacccagacattcctttctattgataataactctttcaaccaattgccaatcagaaaattgttaaatctacctacaacctggaagcccccgctttaatttgtcccacctttctggacccaaccaatgtatatcttaaatgtatttgattgatgtctcatgtctccctaaaatgtataaaaccaagctgtgcccctgacgacttcaggcatatgttctcagtgtctcctgaggcctgtgtcacaggccatggtcactgatatttaactcagaataaatttcttcaaatattgtaaaaaaaaaaaaaaggctggaaatattcaagcctgaaaccactaatgcgtgttggtaaaaccactgaacgaacatgcctttggcttttagggtcttcctaactgttgacaaatcattgaattgctagttaagatgtccaaaacaacaatcaacacccttgtaaaataaattgaattaatcgagcactatccttgaacagaaagaatatgctatatactgtaagggaggaaaaatatcttttccttctactcatcttaggtgcattggctgggtccctgtaatgaaacacagattaacgagaggaaaccacataaatttatctcaaaagagttttacctgacacagaagccttataagaaaatgaagacccaaagaaacagttaaacctgagtgtttttatgatacgtttgttgaagagtgaaaagtcataaaagaatatgataggacacaggggtatgctctcgtggtaataaactggggagacttagcaaggccagttcctttcagtcgtctctgtgtccctgtgtcttcagatgtaaggatgcttctttcctccaggtatagggtgggcacctctcaaatgagggtcttatgatcttcacaggagggtcagaaagcccttcctaggttttatgacctacttaaagtgatggtcagaaagttctccatgcacattctgtttctcaaattccctcagcttaacagatccaatatgccatatgccatatgccatatgccatatttgggggtagtgtgtcctgaacctcatcagtacagaagtatattagcaatttcctcaaccaacaatttaagagatgcaggggtaatttcaaatatatgctaatttagacccagacctccccaaaagaggcaagtgcatttgtctttaagtatcaattctttgaaacctattagccactgtttatgctacatctaacacaaaaagaaaggtagtttggaaagaactctacttttttcctagaaataaaaatacagttttttattcatccctctccagcctcctacaactttctttatgtatcaggtctttttctcagctaagaaacatgttaatgatcttattaacatattgaacaataacccaggaaaggctgacatttcccaaagcttttggtcaattttcaaagtaatgaaagttgccagttattcaggccaagcctataaacgcctgaaattcacttactgtctgaaaggtcaggtaaattagaggaaaatatagggctggccttgaagagtatgaatgtggtgatcctgagtgctcttaaaagtggctgaaactaagaggcctggtattaattctagctgacttcctggtattgattaagaagtaatcgcaagtgctcatttgtgggtaaattaagagacaagtcctttacagaaggtcatttacatgtcttctttttaattaatattactgactggaagatttgcagttaaattagtccattaattataaaagttatcattctggagagtaggaaaggatcatttatttaatatcaaatccaggttttcaataaattgccatttcttctgacactctactaggaaaagtgtgaagttttgatttgtgagttgaatggatgatcatgacctctgcagttctgttttgttgttactgattttattaataaatgtaatataaaaatgtaatattaaaaactgaaaaatacatttaattgttaagaagaaagaaaaatctatctttctttattttattgctcaaaggtaaacctaacattttagtactcccatttcttaagctcagcataaatataaatatatgctttctttaaatgtttcattacttaaaatatagttgcatttttcactttttcatataataaaagcattttcctatgtcataaatgttatttgaaaaccatgtcttaattaaacttcactttgagattattgtaaattcacatgcagttgcatgaaataatacagaagatcttgtgtaccctttttaattttactgtttttaattttggtaagatccaatttattttctttttactggtagtacttttgatgtcaagtctcagaactccttgctagctccaaatcctgaagattttctcctacttttttctgaaagttttacagatttatgttttatatttaagtttctcccaatggtaacatctttcaaagcattgaacagtcaagatacaaaatattgccctcctgcaagatccttcaacttacccttttataaccacacataatttcttgccattccattcttaacccctggaaaccaaaaatgtatcctacatgtctataattgtggcatttcaagaatgttatagaaatgcaattttatagcatatagcctttagggatgagctcttctcattcaggataactctccataattcttcttacatgtatcagtagatcactcctttttattactgagtagtattccatggtagatgtgccatggtttgtttaaccatttaccaaaggatatcttggttctttcaaacttttggccattgtgaatgaaactgctatgaacatttatgtacaggttttgtgtgaacctaagtttttatttctctgtgataaatgcccgagtgtgtaattgttaggtcatttggtagttgtgtgtttagttctatataaaactgctaaactattttctagaatgactgtaccattttacatacccactatcaatgtatgagtgatctagtttctctacattcttcccagcattggtgttatcactattattattttagctgttctaataggtgtgtagtgatatttcattgtggctttaattcgcatttccttaatggctaatgatgttgaatatcttttcatgtgcttatttgctgttgataaaatgcttcttcttgtcttttgcgcattttctaattggattatttggttcttttactgtgaaattttgagatttcattaaataatttaaatactagtcttttgtcagagatatgttttgcaactattttctcccagtgtgtagcttgttttttcatcctcttaacagggcctgtcacagagaaaatctttttaatttttataagatccaatttattttctttttactggtagtacttttgatgtcaagtctaagaactctttgctagctctaaatcctgaagattttctcctacttttttctaaaagttttacagatttatgttttatatttaagtccatgatccattttgagttaattaattaaattgtatttttatttctcatataagataaaattaatatgttcacaagggaagaacgttatgtgtgtggtgtgtgtgtgagtctgtgtgtgtgtcaaataaaaaatgtactgatgaaatgacgccaggagaaaagaggcatgattgaatatattgagtgaaaataaactacagtccatttgaatcagtttcaaaggaatcacaaactctcctggctgcctatatttctttggtgagttctccaaaggtctagcttagtatgtacattaatcacttcactactttccctttattcgtttaagctggagaggtctttgaccaaccaaggaaagatactataaacaacctaagatcaggaaacccttcactagaaataaaatttatgtatataaccaccatagcattttcttcctaggaaaatgtaaaatgatcttaaataaaacagtatatgtgtatttgtttacaagaataattcctctatcccatccttataccattgctgtcatttctttcacttatacataagtatatgcttgtgtgtatgtatatgtttgaatctattattctgaacacactgttatctattagatcaattaagaataataaaaataaaagttttgttttactcacttatcctctgatgctcttcttttcttacgtaggtacaaatttctggcttaaatgattttccttctttctaaagaactacttgaaaggcaggtctgctggccacaacttctctgaatttttgtttgtataagaaacgttttatttctcctccacttttgaaggataattttgttaccaggaggaggtcccagtctagaccccgagagagggatctttggagctcacacaaaaagaattctgggtgagtccataaagtaaagtgaaagcaagtttattaagaaaatgaaggaataaaagaatggccacagcagcagtgtgagttactcaactgattatacttatacttatttcttgagtatattctaaacgaagggtggattattcatgagttttccaggaaaggggtggacaattcccagaactgaaggttcctccccttttagaccatatacagtaacttactgatgttgccatggcatttgtaaactgtcatggtgctggtaggagtatcctttagcatgaaaatacattgtaattattgtgtaatgaccagtgaggatgaacagaggttactttcatcatcaacttggttttgatgagtttgggccaactcctttaccacatgctttattatcagcaaggtctttgtgacctgtgtcttgtgccaacctcctatctcatctgtgagtaagaatgcctaacctcctgccaatgcagcccagtaggtctcagtcttgttttgtccaacccctattcaagatggagttgctgtggttcaaacacttctgaaaatttcagagttctaggttggtattttttttttctctctcaacactttaaatatctaactctactctctcttttttactttcatgttttctgagaagtcagatgtaattctttgctcctctgcagaggagctttcatttcctctggctttatttaggtttttttttttaatctttgattttctgtagtttgaatatgatataaccagttgtaggttttgtttgtttgtttgacgtttatctgttgaagttttatgagcttcctgtatctgtggtttagtgtcttacattagttttggggaaattcacagtcattgttgcttcaaatattgcttctgctcctttctctttttctgctcctctggtgtgctcgttatgcaaatgttatggcattcttagttgtcccatggttcttgaacattctgcttttttttttttttccatcttttctctcttgcttctcagttttggaagtttctattgtcatattctcaaactcagagattattttctcatcagtatccagtctaccagtgagtccataaaaacatttgtcatttctgttagtctttcttatcactagaaattttttaaaacctagaatttccattgctctttttacatcgtctatcttttcttgcatgttttctacttcttccattaagcccttagcatattcatcatttaaaaaaattcctggtctgataatttcaacattcctgccatatctgactctggctatgatgcttattcaacctcttcaaactgtatttcttgccttctagcatttgttataacttttggttaaaagatagacattatatactgggtaaaaggaacagtggcctttagtaatgtagtggtaaggtgtaggagcagggaaagataatcatagcttcttttcatagctgactttaagtgttatcataagtgctgtctcatttaattgttagaacagtccaaaagataggcaccattatctacatgtaacagataaggaagctagagtttgcctgaagtcatatggctaattaatggagaaacctagactcctcccactcaggtttttttgactcaaaatctacttaagcactgtgctacactgagttatgtaaaaccagaaactacatttctgatccatttaagttttgtctccactacttaccaagtttgtgacccaggtaggttgcttaacataaaattccaggtttctcatctgctaatggggacaataatagtccctgcctcatcaggttgtgataaatgtgacaataattctgacagagaaattaactgtatgaattacactacaggtaatacttcaatttgcataaggattgagaagggtacctaatagaaggagacaggtggcaaaggagtgaaagagtgagaaggaattggaaattgccattttctcttcctttttcctttgttgggattctttttgagccatgaccactgttttcccaccattcttactatccacagaggagacttggagcaggaaagacaaataattattgaacacttactacagtgatgtcaaaaattgttgtaagcacttttcatgtgttaacatgacataattgacaaaaaaaatcatataagtaagaaaactgaggcgtcgaggaaactgagacttgaataaagaccatagcttatgagtgctatacttcatgtgtgctttatttttgaagaggctagtgtttgagttctcttgcctctgagacatttcttgttcattaatttctaagcactctctcctcactggggtgaagagaccacctggagattcttctcatcaccaaaataggtaggaagggtatccactgattctgccattaacatatctcagacaggcccttcagaacgattcaactcccattgattttcacagagaaaagccccattcagatggaaagcaaaggacttatttgttcctgacataaactggtgtttcatgctggactcagtaagtgctgtgagtggggaggctgaattcagatcagtgaagaatccagagatcattcttaccaagcaaacacattgtgtggcccgctgggcacagatactaaaaaagcatcagaggcatgaggtcatggttgttttcagactatccagaaatttattccagaagtcctattcagcactaaactgcagtatttcccagggtggaggaaggagacaacagtgcattatgacacatgtctaaaggcgggggctttggggacagactcctgggctttgcatcccagcttcacctgctaactctcaggcaagttacttagctgtgcctcagtgttttcatctatgaaaagaacacattaatagcactttctatcttagggtggtcataagtattaaatgagacagcatatgtaaagtgtggaaaatagtacccagcacaccttaaacgaaacagcaaaataataattcacttttgctgaatgcaccttcccatagggtctcagtgctaatttcagacagtaagtcaaccactgttgcctctatgttgccaaatttaacaattaaatctgttcaacatgtcagtgaaatacaggggaatttagcaagtttttaaaggcattttccaaattgctaattgtatgatttgcacatgctacagctcaaaggaatggtgcactggtagccagagctaggaaagaactaaggaagaaagttatcttcctcaagaaaagcctcctgcttctttcccccaacgcctcggggcaactgggagatataatggacagaatacacaatcgtgaatgagaagttcggtgttcaagttgtggctctagcacttaattgtgccagttactctgtctaaaatttaatttttctatttgagaaatacaggtaacagcacccacacaagtaaatgtatttaaatgtctttaaatgtctttttaacaaatagtgccctgtgcaaatgctacctattatttactacactgatgcaatcattcaaatgcttatgtcctgggagggtctaagtgcttatttacagcctgttataaattaccccagaatcaggctgctttcctcatagacctggctgggaccagggatggtgggtgatgggagagctttccctctgctgtggtaagggtaaagaataagacttcttggaacatgaggtactctggagctgggatgggaaagggtccagagagaaagattgtaggattctgtgagtttcacatactttgaaatgtggctgatgcaagacctgataaaactgttcatcaagatgactgagaggatgatggtgatttcagtaattacaacttacctttcacaaccgttttcaagcttaaaaatctccttttctcttgaaaaactcatcatttcctggtaaaatagaggacaagaaatacactttttgtcatccttagattgctagtttcatggtggtttgaaggaaagaccaatgtggtaggaggcagcagggtactggagacagaagtagactgcttctaccccttactggccatgtgcccttaaacaagttcccgaatccaactgggacgtggtttccttatccttaagaacagcagcacccactgcaaaggctgtgatcaagattaaataagatccttcatccaacaggccttcttcctggcactcagtaaatggagtccattatcatcacagccacccagatctgtcaaggtatcttgccatcggaagcactatgggagatctataaatgctggttacgttccattcatggtgacttggattattacactgcttcacagagtgggaagctgaagcccacaaagatcaaagggcttgatgaagcctataaagccatcttgcacatcagctttgggaaacatcacgtaaggcatgggcctggagaggaaagcgggcccacatccaagcttatgtcagtcagatgctaaaatgtcattatctctacactgaattaagtgcttgtatatgttgctgcacaacaaaatgcattattgatgtactaaagttttcccgctgggtttatctgtggtttgcatagcgaattttgcacagcgaattttgcacattttgtcatcacctgtatttgaaaataggatgtttcttgacgaatgatcccattatctaatgagtttcatcattaagttttttcatttccaatctaaatgtttcatttcttgactgtataatgttacttcttattatacaatgctaaatcattgttaagtaattcttctagcctgttttgttactgtcttccaaatattaataagcagttatccttttttctcagtattatttatctgtaatctatacatgtgcaatgttcttaatgtctttgcatagctcatgcttttaatcactgttatcagtttcatttgtgttccagtttatcaagaagttcttatagatttctcatgcataagtaatggttttagacaacatcctattcaagatgatatttttttacacccatatattggtgtctatgtctctcccaggatagcaacctctatgagggcaaagactgtcttttttaaaatttcttcaatattttattctgaacacctagcatagtggctgcaatgtagtcatccttgatacatatttgttgaatgaatattgaatatgtagctgaaattcattttccttttattaaagcaaataattcactaagctctcaaatatctatttgtaaacattttctccctcctaacatttttgtgtgctacctaattaatgtaagacatagccccaggggttggcagtagagaaatgaatcaggtcttgcctgtccctgatgggaagtaatcagataattctagtaatgctggcaaatcacctggatagggtgactctgtgccaggctttgtttaacacctcacttgtatggatgtatttcatcctcacctctacccttttttgcatgatttttttatatttccttatctaatatacaccataaccctagtgagtaaggtaagttaattagccgctctatggctcagtttcttcatctgtcaaatggagttttatttattgaatacttatattttgcatgcctactatgccaggcactgttgtaggcaatagtgatacagcagtgaacacaatgaacaatgctcttgccttcatgaagttataatacatccatagcagcacatacttcataagattttggggaagattaaatgagatgatgctagtaaaatcaccaagaacaatattggcacatagtaggcactccataaatgctaggcattattttcatgcaaagacatgcatagaataagtaggcaaatacatgctttctgttgattctgagggaatttaaggaaagcaaatagttaatgtaaaatcatcactctaaaaaattaaaattgttgaactatgatgaacccaggaattttggggtaacatatgcttttttagactggtaaatactaatcacagtattttcaatttgtttcttttcattaagcatatgaatttataaaccttatatatggatctgtattcaaaggtttgattcattatggattttttaaaaggtgcatactaatctttctaatgcaattactgtagtctccacttatctgtggttttactttccatggttccagttacctgtggtcaaatgttgtctgaaaacagctgagtacaataagtataataaaatatggagagaaaaagagagaaccacattcacatgacttttattataatatattatagtcattctattttattagtaatatattgttaatctcttactgtacctaatttataaattaaaatttatcataggtatgtgtgtgtaggaaaaacagagtacatatagagttcagtactattctctttttctggcatccactgcaggtcgtggaatgcatcccctgcagataaagggggagtactgtacattagaaaattgtttgagcaagaagtagagcctgaactataaaaacatatgtaggatggagccctttcttccaactgaacacaaataatgctctgcaataaaatgaggtataagccatacagcagacaattataatgggatttaacctaattagtattggagaactgagagtcttcattaaaagtagcacttcataatcatgtaatcaggaagctttggttcttaaaggctgacaggagatctgatccttaaaaaaagtgtttctaaattttccaagtgtattcagcaaatcgccaaaacgtgcttgattaaaactgtgatggggtgtgtatccagaacaccatgcatcctctactccagttcttccatcttgattgctttccccaagtcactcactgaactctcatcacccccaagttctgcaaacattgcttgttatttcaaaagctgaattaaatgctatcagttgtgaacttcctcagcttaccttctctttctgaaagcactccctctgtctgactcagagaaatctgcctccacccaaaaccttcaactccttctagaaatcacatatttcttcatctgtttttctcccccaactgctagatctttcttttcatcatataaacaagcctcaagcttcttttttaatattaagagaaaagcaactttcctccagctcttatcctgtatctctcttctatcagccaagtttctggaaagagaaatacgtttttactgtttccatttccaagtcttccatttactacccaaagaaagggacccttgccattccaatggagctgctctctcagtggccactaataaccacttcatgtaaattcaagccaacacctctccgctgtcaggttccttcttactagaactttctgtaggattagaaacttttgaccatactaccatcaactctttcgaaaacccacatctccagagagacattgttcctgacttccacaccagtgtttcaagctatgcctactcttcctcgatgtcgcctctgtaatgtcttaacatgtcagagattaaccttgcaatcccctctccaccctgccccatctctgatatttctcaccttggtgagggatgctgtccttcacccatcgcctaatccagaaacatgaaaaatctttccataccctccctactgtctatatccacaatgtcctgatgtcagaataattttcctgagatgaaaatatggtcatgccatttctgtatttgtcactcttcagtggcttctcacagcttttgaaagaaaagccaaaatatttagcaagatactcagagtccctcgtgaatttgcccttgctaaattttcacttctcatgttaaccttctcccacatgtatttgtcactccatctgttccaaacttatgttagcttccagagacttctgttctttcacatctccagaacaatcctgctccccctaatacctaatgaaattcttgtcttcaaaactcaatttgagtgccacctcttctgaaaatgtttctgctaaaaatttctcttctcttcagagctctcagccaccctactgccatcttaatatctgtgcattagctcatgcctcgtttgaaagtctctttgactaggttttaagtcacttaagggtgagtacagtgtcttatcgatgctttaatcatcaagtctatcacaatgtctgattcaagttaggcactggataatacatatattaaaattataacactatgtgcatagcccagtgaacactgaaatgacatgcaccagtgccccttgtggtacattcagaaacactgcaagtgggtcacacccaagtgaaccctgatgcttcccttcatgtggtggcctctcagtggctatctccatttctcagatatgaccctctttcttacaggaaggtgatcccataaataagagcaaccacttatattgatttagtagattcccacatctatctccatatttctaacataacatttatatatttttaatataatctgctaatatgaaatttttgtgtcttcaaaaattgaagtgcttattaaccctttagagaacacaactgagaaatgctggactagagtataaaatgaaaatatcaagataccttttacatatattattataaaccttgtataattttcttccttcaaatctgagcagaaaacaaagtttctctgggtttgaagtagaaaagttatttgaatagtaatcttttaagatagttgatttacaaatgtcttttttttctttgagatagaatcttgctctgtcactcaggctggagtgcaatggcatgatctcggctcactgaaacctccaccttccaggttcaagcgattctccttcctcagcctcccgagtagctgggattacagccgtgtgccaccatgcctggctaatttttgtatttttagtagagacggggtttcaccatgttggccaggctggtctcaaactcctgacctcaggtgatccacccccctcggcctcccaaagtgctaggatgacaggtgtgtaaaaatgtctttaattaagaattaagtttaagtgttcctgaaggatcatgcttctcacagagagagtacattcacatgctgatttttagtaaatttaataaaaatatgcccctaaaatattgttttctgcctaggggaaatgccccatctctattttatgctgcaatgcttgccctgggaatggaggcagagtggcacttggctgcagaggcacagcagggtggatcaatggttccttgttttgggtgtgtagaggccgtgaagtatgggattagagcagggccttgggagcctaatactcctaactacaaatccttatgctgccacctactagctacgtgattgagagttactgaatctcttttaagcctcagtttctacatctgtaaaatgaggaaaaattaattcgcacctcgcaggactgttatgaacattatcattttagaatattttgaaaatgggaaaataaaactagttttgaagattcaccctcaccttattttccatatgactatgtcttttgcgttgttattgataaccctgtctgtcactaacatagggtcctgaatgcttactatctcagtaatctgttcttggacgggggatttgtatatacatttatggttctgacttacttgtcaagtcacatgtttctgcattgggcagtaaaatacaatagtaacaataatagtattcaccatgccaggcccctgcatatgttatttctcatctgcatgacagcccccacagggcaggcatcagtggctgcaggagagaggggcaccacagataacagagagaaatagtgagctggagggcagtctatgaaatgcctggtgaagtcgtgcccacaaccttttgggaacaaagctgccaaaagtccagctcatctttgagcacagatgccacgctgtctgtcatggacccctccaacttcagccaccttattgaaggccaacgtgtctcacactggcagaaccccacctgttagaaacccctgaggcctttgcttagcttttggagggggaaagaatatgaagaaggcagccattcctacaagaggtgcctgtcatttctggtaacctccccacttctctgtcccttcgcatctaagagagtacagctgatgcgggcaataagggtaggagggttcagtattaacttgtagattttggactatccttcctctctctaaaacacaaacaaaaaatagggtgaatgtaggcatgtatgctcaatttaactgaaaccaaggaataagaaatgcaattgaaaccagcccaattgtctcatagaacatatatttatggtttctgttgaataaacatagaaattgaccctccccatcttaaaacttgagaaacttacaaatgtcttatctgaggttttttttttcctcaggaaaccaacaatcaggcctcccacatagatcaaggaattgaaacttaccagatcacttcatctggacaatgagatactagacaccttacccatcatgagtgcctaagcgaccacctgctattgggttaccagctcctcttccatatccctccctaattcctgttttcccacacatgattacatttctttccagctatacaaactcttaattttagtacattagggagatggatttgagactgacctcccttctccacagctgcaacaaccaattaaaggcttcttccctggcaatacttgttcgtctcagtgattggctttctgtgcagcaagcaacaggacctagaccaaacccctggcattgtgataacataattacatagacaactgttattctcagaaagttttgtccacaaagagtagtagctgcacttctcagagatgggaagaggtgggccctggtggggctctgcagggacagctaggagaggagagacagagatggaaaggagcaaagtcatgcttgcatggacttgtggtgaaaattctccaaaattgcctttaaacaaagaagagaaagaggagggtgagtgaatggagttacttgtatgggataaaccaaacaagaatggactttataactggccttggaacagcatggtgaacatggagagagaagagaaaagaggaagagaagcagggaaagtagaaagaaggaggagaaaaaagacagaaagaaaacttaggatgctgttttacataggaggctaagctcagagaaggaaaagataaaagctcaacattcataacaagacaagagagaacctggggattctaatttacctggggggtcgggggcatgggtcaaccatgagaaagtgggcatgagggaggaaacaaacatcacctctgcagagaccttaggcactggagggactgtgacagggtatggactgcatccgaagaataaaaaataaatcaaagatcaaataaaccaggcaaacacaggaaacacctgaaaaatattttaaatgctctaaatacatgccttgctacatgagatagtgtctagttgtgagctctctcaatcattattttactctgagctttccataaattgtagtatgaaacatatatacatatgaagagattctgatgataaaaggcctgatttgtgaaagtttgaggtaacaattgcaaagtcaaatcctgtgcttcttaaaggagggtcctcccttccaccagctggtgacctcgggaacttccttctgcacagcatgcctgaatggatttattgttgggaactgcttaggaaagtgctatggtcaggagatttttttccaccccaaaattagtatgttgacagcctaaccccaaggtgatggtattaagaggtgggacctttggaaggtgatcaggattagtgtccttataaaagagactgtgagagggctcccttgcccctcctgtcatgtgaagatagagtgagaaggtgctgtctatgaaccagggagcagccctcacaagacaccaaatctgcatgaaccttcatcttggactttccaacctccagatatgtgagaaataaattttgttgtttataagccaccagaccatggtattttgttatagcagcctaaatggactacgacagaaagttttatcatattcccatattgttgtctcttaatgatactaatcagtgacagaattttagcagaagccttactataatttggaaaaatccaagacaaaatatctgagtggtgactttgccctgtctacacagaatagaccactgcccaagcagtctgcatatacaagttcagtctgcaccaagttcagaatggagccgtgtgataagaaactcaaatcaaagtgatggtagctgaagatgattccagctggcaatgagaaaatatacaactgattttattccttcttacagtttcaaaaatagattgaagttgagaattgtactttgagaaggccaagtttccagctcttaataactaacttatttactgtactcatttcacagtctgtgatgcagcaatccacaaaatattctatatcagtctcatgatgaactattaaatgaagggacatactcattttttgagtttccaaaaattatagaaataaggtagcctgtgaagacttacatacacacatgcacacacatacacacatatatatacccttaagcacacatgctatcaatagctctcatcagaattttcctagtataagttattaacaatggtgtaaaatggacaataatgtttctccttgtactttcaaaagatgaaatttacagtagtaaagagcatattttaaaatacaaatctctgaacaatgttgaggttgaaaattcatgcccatggcaatgccaaggcaaaataaaaggtctcgtagagaataatcttgtgtttgtgtattgtaagtacctctaggggagcattttagtgggcatactttcattgatgaaacttctttttctagtcaggaatttcctcacacatagagaactgaattaattttatactgatattgtaaacaacaaaaaatcatgtcactggtatacagtttgctacaaaacttagaaatcccaattaatcttatgttcatactgtataataatagtaattagtgatgttaaattgatatttgaaaatgcctaatagttacctaaactcattttattgtgattaactctatactctctcacttataattgcttgaaagttgaatttttgcttccttgtagtaaatgagctttcttattttacgtgaaaattttttttccatttcacatgtataactacagctatcagttttttctgaaaagtgggaatccattatttttttggaaaggtatggtttcaagtttatgactctgttgacaaaacaatttttaaataacaaaatctaacagcagacataactaggtatgaaacaaacatttgcctctaatggataaagttcagtgtctctcccaaagacttttcatcctttccatttcctggcatctttgaagaacatccctgaggctgctctgagttcctagtgacaccccttaatgcatggatcaagcaagccgtggaggaaacacagcacctgggcagtaggatgcccatgcaaataaatgagcttcctatctctgcaaaccttgctggaccaggtggttttgctcttttctggccccgcaagtaaactgcagtaaggagacactaatcagtttactgctgagaaattggaagctctttcagcctgaagtgtcttacacagaaaaaaataataaagccaagcaataatgctcccagggaatgttctctttatctgtatttagtgttccatcactaggaatccttagtcctttgttgctactattagacgagcctaaatggacttccaggcttacttcatttgactcaagggggtactagaattcctgggcatttgtcattaattcatttgggagattcaaattgcacagcgatggttcaaatagtacagcagaaagaagcctcccagggcttggctggatgcctccggtgtctggggcctgggagtggggtccttctgtcccacacatgagagtgaggccaacgaggggagatgaggaataagaacacacaggaacatgtaaggtcaggttccacaaggtgagatatgcaacctattttatgttgacccctctgcctataacacattataaacaccattctgggaaggcagagaaatgtacttatggcagttcttcattcattcctaaaggactcgccagttgattcactatctctgggggctttaatattctaaagctgtggaacagctcacagtgtatgaataacattttctgccttgtggaaatatgtaaaatcttggaaatgtgacttcctccaactatgagtgttcctagtatgtttgactcctgtttaaagaccttgcaaagaaagtgaatgattggctcatgctaataaggtttgcaagctcctcagggaaacaaaaaattaagcagtgatggtaggaggaggactgattttggataaaaacccatctccactgtttttctcacacttgtcattttgaaaaaaacactttctccatttttcttattaatcctcaacctcatggcagggtttcctaatctgagaagtacattctacatatgtagaacatacagggactagtgttgcagagcagtactttcaaatgagagtcacagagaggcaaacaaagctagagacaggatatggtatgtatcatcaacacttgacttacacccaccattcaaaatcttctgtattatcttggcaacttgtgattgaaacgtctacatgcccttggaggagtagatttaatgagaagaataactattgtgtgggtgcagaactagagtgtatcttcgtctcctttaccccaaatgccaaaaatggcatcacttattagtattgctgatgctgtttctttttttcaacactaccccaatttaatacttacaaaaaaagccagcccattcctactgctattgatttaaccctgaccccacaaccatatatattccttccctaaaccccagtatagcttttgtgtacctcagtcaccagtattctgtaagtgcagcggtagataggtcttgtaatcccaaatgttcacaaaagagactaggggcttgacaatctctgtgctcctcccaaaggcaattctggcctcattgtttgttttcttaatgtagtgttctaaactaattcagactcttttacacctaggcttttctagaaaattgccctgaagaaatttgtaactttctctgcaagtgtactatctcatcactcttcttacatctcaaaattagaaaaaaagaactcaaaacctcacactatgccctttgatttaaagtcagggaactgagtgagatcactgtaggctgaggcagacagacacaggaaagcagacagagaatagaaggggaccaatgtttgagccctgggaactccaaaatatggaaattgctttgggaagaagcttccagtgagatataaggaaaaccaagagagtgttgatgtggaggccaagagaagaaagtaattccagaagagaggtggccaaccatgtcaaatgctactagaagttccaatgagataaggttagaaaatagaccaccagatttgacaaaatgaaacccatgtggctagagagacagaaaaggaatgaaactcacagggtttggaaggaatccctctcaacaaagagagatgaggacaaaatgaaaaaggagtaacttgcttggaagagttgtacagaaaagagctgaaaagtgaggcagtgcccagaagacatagtttacacggagtttttggtttcttatttgtattatgtacagacaatattaaagcataattgcaagtcgaggttgttgttgagaaaaagaaattgaccttgcaaaagagaggggaaatcataaaatcaagatttttgagtggattagaagtgataaaaatagacaagttggtcatcagcaggaacaagcaaaaagagaaaagggggaggatgtgggtgcagagagtataaatttgagttagtttagtgatgagaagtgaagtggtttttttctgattacttccctttttattaataaggaatgaggggggccataactgatgaggaaaagagcttttggacactgaggagagaaatataagtcaataatcatcttggagaatgggaacacaaatgtaccaggaaattatagtaggacttctaagctttaccaaatgtccattcaaactttgtagtcataaatttagcccttatctctaatttgacgtttagcactgcatcacattattactaaccattttgtatgtgaaaatcatatttttcccaatcatttacaagtttctcaaaggtggaatcccaaggttgtactaattggtatcttctccagggcatacttccgtgacctggcaagtaggtgcctgatatggtttggctttgtatccccacccaaatctcatcttgaattgtaatccccacatgtcaaggaagagacctagtgggaggtgataggatcacgggggcggtttcccccatgctcttctcatgatagtgagttctcatgagatctgatggttttataaggggctcttccccctttgctttgccctctctctcacctgccgccatgtaagacgtgtgtcttccccttctgccatgattgtaagtttcctgaggcctccccaggcatgaggaactctgagtcaattaaacctcttttcttataaattgcctagttttgggtagtatctctataacagtgtgagaatgaactaatacagtatctcataaagatttgtgaactttcagattgaagactgaatttaccattgtgaattaaatgcctgaggagatgtttctagcccttctttcctctgccctgacccatattaaaagaggtattcatagaaatcattgctctttttcctctgcgcgcacccagcctggcaaacacgtctggcttagccctcatatcactaaaggtatccgtgggattcctctgagcaccccagaggtgggtctaaattctccatctactcaaatatgtcctctactcatcgaatctggtctaggacctgaagaagcactggtgtgaggtggctgtttctagtttcttaaatcgaagctgaaaactagggccagttctattcagtcatgtttttgtgtccacattctttaaccccagtaatgtctaaccctcagcattatggtagtaaaagtcagacactgtgcctgagaaatagaaaagcctcatttatttattttttttttttagtcccttgcttctcaaagttggtcctaacaccagcagcacaagtactatcttagagcttattagaaatgcatcttggttcttgggttcatggattcactccagacccactgaatcagaatctacactttaacaagatgctcagatgatccttacaccaccaaaatttgataagcactcttctagatgataaaagaagctcccaaatacagttatgtaattgtgctaacagaaagctttgaaaaataaatgaaaattttaataattgctttgatttttgttcataaataaagacacactctattgctgtgtgtcttgctggacctaaggaacagaaggattttttgatagctgtcaggaaagctgaactctgtttaatgtaggctgactcttccatgtaattgcagctaaaaagttagctatgaaataccttatcacaataacagaaatgctctcagtaatccataaattctttgtagcacatttgctttttgtaggtttttgataagtggttgggaggacaaccagcagtcagaaaaacatctgtattctttaagagcctgactctagacagactcaaaattcctggacacagagaaatgtttcctgggcattcagatgctacttagcaagttaaatagctcattgattgataaagtgagaggcaagattaggaaggggttagttatctgagtaacctattcttgaatatggaaatcacataattattttcaagagaatgtgtgtgagaacgaataaatgaaaaagttagatatagctttttttctgtgctacaaatcttatatgtttattgaaagtcttttctctaagactatgatgcatttggctaagattaatttcagaaattttacctgtatttttaatctcatttagaaatgaatagtagccataaaagaggcccttattgactgcccagagtggtgggtcacaaggtaacatgttctgagaatgctgggatgcaacctgccaagagatatatggatgaaacaaatcagaccatgcaaccgcactgcactcctgggaaaaatgctttttaaaaaaataaagataatacatgttttttatttaaagtttagaagttgagaaaataacgatgacaaaaacaatgctcctacacccatctgttctgagcttaccacttgaaacccattattgaaatagaaaccagtttgtcactggtaagcttgaggttcctacatgtcaccatgtagcatgacatagcagaactgtcatcgaaacctcagtcagaattttgtatttctcaacaaaacgtatacccataggatactaatgggcacagtccattacaaagacataatatcattttctatatttattatcataacacattctcacacctatagagtagtttgtatttaatattgtcttttaggcttctgattttgacattggataatgttggtgctgacctctgactgccaggttctcaaaggacagcctcatttttataatttattccccctttcttggtctcttggtacaatgctaaacaatataatgcacaaagcaaacaaagcaaataactgaatatacacctttttgctctatctggtaaggcaaatatacccacttaattcacaccttaataatttattttaaaaaatgttaatctcttttctttaggagcttttcccttggctccttttcctgcagacaaagtaggtagtttactttgtccaaagtcgtgttaagtacaaatgaaataatgatgagctttatgtaggcagattcctccctcctttttatatattaccatttttctcaattagtttatatgctaacatattgtaaacagaaagacttgttagtaaatacaaaaagaggcatgcattttctataataagattgaataaaataaaaaatttattggaactatctgaaatttatatattattaagcacaaaagggacaccttcaggtttttgttcagatcataattttggagcattttttggttctagaaataaatggaaatgaccaatgaatgttagtgctaaaagaatcctttgatagcatctttttttggcctttctttaagataacttggcaccagaataataaaataatgtaaccacatttattcaattagagtatagtggtttaaatgcacagttgtatttttttcacctccagtatagtaacattattctacaagttagatatgactttacaaatttaatgtgctaagaataaaaataatgcacaatcagctaggaagttaacacactaaaacataacttaaagaggtgaagagtaacttgtccaggagtgattttctgcaggctggcctcccaaaggaggagttggcaacatataagtctccaagaaaattggctaaagctgaatgtccaaggcagttaatcctagttgaataccgatgtggagaattgggcccaaaacccactatatcataggagctgcaagagtcaagctttgatcctgccctctgatcatgctgggaacagagctgttggttccctgattgtgcagcttaatccaaggcctggatcccctctccacattccctatatctgaaggaactgtggattccctgtctcagaacatagggggcaatagggacctgcacaactgttcctcaaataaaccctgcttcagaaggtccattgtgtgtgcttttgttgcacaacatccacttgtggaattttcctatccacattccgaacgttactaagcatgcctttctatctcttaagagcttttcttgttcttatatataagtagttggatctcttgttgttttttatatataagttgttggatctcttgatgttttaataaagtaattgttgtgatgcaaaatttctttcactgaaatgccagatatcttccacttgattttcacccttctctttcccctaaatgctcagactacattttcatggattctattaaaggacacccatgctctctgggttccagttagttttggtgaataagaagacccagtaatggatggaaaagaaagaggaagatgaagccagggattttattctcccagcttactctttatgaaaccacttcaggctgctggggtcccttgacttcatgccattgctccatgtggttctttctggctaaactctcactctcttagtcccttcagctttaggaggggtgacatcctcactgctcctgctgctactaggctcctgcaccattctttgtagttcccgtaggtctttttattgtctttatgattattctctttgcaaacaaaggtctcctcaaaatatcctgacttcagtgtaccatcttttctttttgggaccctgatagatacaaataaattaggtgcaacatcctgattaagaaatatagttagatctttttttgaagaaggctaatagtgttttttttaagcctttcaaaatgacacttttagactacccaaataataaatctgtgtttaatatgtctacccttatatctatctctacacctatatccacaattttctggaaattcagaactactacttttaggaactttttaaaggttaggtgaatcagatgttcacataatgaagtctgtggaaaggacaactatagattggttagctttggttgtgactaaaaggttaagtagtggcggcttattgattataaatattgactggcattttctttaataatacttttgatttttgatggttcctcagaaattaatatgtatttggaaggtctttaattttcatcatccacagcaccttgcacagtgttaagcacaaaacagatgagtaataactggttgctgatcaatttgtttgcataattaattgcttgtgcagttgtctgcattctactctgttgttttttatgcaggcaggccatccatagctatatcatctctggaaaatgtgaactctgttgcattttttcattcaatagattaaaggaacacccagagggaaattatgtagcaaatattacttgttggaaaggtctttaactttgcttgattaggttatctgtcacctaagtcaaatcgcagtggtctcttgatgatctgattccagcgctaattcagagccagcaggggaggtggagccaaagagtgtaagaatagagcttgggtggctgttaacagcggaccactcttcaatggattcagatcacagaattgaacagcaggaaaataaggatagttctggggcaaagccaaatctgcagttctttgaagctattgcatgtttatactttggacaaaaccttccttttaccccaaatttttattctatatttttgcagtttgtaagtagagaaaaatcctaccagatactatgtgaatgacagaatttatttatgactctgtgataaatgtaatgaagtcatactgcttttggaaagggatagatgtagggagaatactcagttttgctgaggcttaatttaaatattaattaggataactatccttaaagtaatcaagaagtaaaaaggctgcctgtacaacaaccacaaactacaacttttaaatccttccccttttaaaatcagatacaacagtggattgaagattttttaaattaatcaagtgtatatgaagtgacagattatgtgaaagctcaaaggtcttctcttaagtagaattttgggagggattttgtaaagggcatcattactgctgagcaccaactttgttttgggcatttaaacatctattggggctttcatcctcagctactgctcttatcagtccaattttgtgatgcagatcatctgagattcaaactttcccttgtttagcccacaaagcaatttttaagaaattcaaattttcaattgcttagctcacaaaacaactttcaaaaactatgttctggttaatttaggtacccattcatatgaaattatattctactttccgaaaataatactgctctcaaaatgtgttttctagttgattattaaatctcaaaacttattactttgaaatacataccaaaatctttggagatggagttattatattgcaatggctattatatataataactattatatatcatagatgcaatggcctaaaaatcaaatggcgttttccctcattctggaaaaaaaaaaaaaaaaacagatgcagatgttctgctgcctggacatctctggtcatgtgtctttccatgaaacagttttatcctcccatcccccataccaaccacaattaagaggtttaaataaaataaaactaagaaagtgaatttttagagatgtaacctagtcctgctaataatgtaggaggcattcatttacattcaaaactgcaaaacagagcagagagttaggtttggaatctgtgcttgtggagccttttcatttactcacccaactccaaataagtcatttaagatactaaagagaactagtgcagaagatgatatgcttagacataaaatatatccttatttgaacctataatatcctgttctgaacataaaactcaaatgtaaaatttaattcttatgtttctaatgtttataataaaccactgtatttatccactttgaacaggcttagcttttgcataaagttgatttctttgcaaatctattccattaaacaattttcattcataatatgagcccgtattacattttgtaaccctaaaaatcaccatcggcatcttctattcaacagataataagttgtaaacagagcaaaaactattacggaaaccatgcatataacatgtaaagtaacagtatcaaataaaataaaaaatgaccaaaaatattttaaaggtacagtagaacaggccaatcacaaaataaaaactccaagatagacaatcatggaaagaaatggtactgaatgtcagctccaagatgcatcaatgagtaaaaagatgacttgtgcccccagctcccagcacaaaggccctggcaagcaacttggatgagttcttaatttactcacttgctatgaagtcaattcttaaagaccgtgtgtgggtttttacactctgtatttcaccaaatattagaatgtaagacaggaagacaaacgttgagattcataacaatagcattcacatctacatatggtaatttcttagagctattcaatgaaaacttccacctcggagctgacatcttagaattattttgataccatcccttgcgattctgtaagcaaagttgttaagagtctgcaaaggcataaatgcatagagcagttgtctaaaattcttgagagaaaatagtaaatgttctgggactccatgcagatgaaaagcaaagtggcagaactacttttaaagttgttcatccattaggctaatctctaagccaatcaggttctgaggaaagcaattatgagcaaggtggacagagaacttgcctaagacggaaaggagaattcaacagtatctctgattaagtgctttaagtgctgtgagaacaaatctacaggtgcggtgtgggtttggcagggatctccgaccttaactaggaaaggggtggggatccagaaaggcttcctggacgaaggaatatccacggggaaacctgaaggattagcagaagttagcaaagtggagaggagggaggactgttttaaggagaggaaatagcttactcagactcagaggtgagaaagaacatggatccaagagaaaataaaaattcagtagggatgaatgaagcctgaatcccctcgattgccgaaaggcaagaagtgagcctggagatgaagttagggaataaggcataaaatctaaagtaagtttcattaaagcagttttacttgagacaagagtctttgagattgatgtttcaaagaaactgctccatgcaaaatggactggaggaatgcaggtgaggtaggcggatggctcggattggttatggcagtggagatggaaagaacttgatgcaggtggggtggatttagaggtaatatcgtcaaggcctatgagaaacaggatgtacagaatgagaagtaggaaagagtgagggaccaaagtgattctcgggtttctgatttagacagctgggtgcatggtggtgcagtcactaagaaaaacatcaagggaagggcagtttgagattaacagatggatacgttttgggcaaaatgggttggcaatacttgtgagccgtccaagtactatgtcctgtaagacatggatccgtgtagatccgtggatctggagctccagagaggaacctgggatagagatggagatctgagagtcatgagattacaattggcggttgaattttattgagtgggtgttgtctctctagaagaatgtgtgtcgggagaaatgaccgagggagaaccctacagagcaccataaatgtgtgatgagcagagaaaaatagtcctatgtcttagcccatgttccctaagaagcaagctggaagcaaagctacacgctaaccccttatgggggttgcaggaggataccatggcaggatagaggaaatagaaaaatagaagtgaggtaagaaagtcaagaaagtaaatacacaggggtatatcacctagttagcttcataggaatcacagcctggtgctcagtcactgagacactttcaggaaaaccttaccttacagaaggaatccccttaacaaaaaggtgaatgtacagtttgtcttccagcctcttcccttttcttgcctctcattgatcaacatttgcctcttagccattctagggcttagttaatctaggcagctcttggagaaaccagagcctccatgggtccaggctggttgagccaaggtgctggggcttcttatgccctccccaagatgaacctgagggaggccttgccacaggtcagtcagtaagctctggaagaggctgagacagagggtggtgttgggagatggagcaatggcatccggagctggaattttgtaagttatgcagtgatgtaagcctcaatggattctcttcagccaggaattagagcaagcagttgatgatctgaaacaattttggataatgtgtaaactgggtctggtatatcctgtgaagaagcctgagaatgattggtaagataagtgggagaaaacaaataatgccaaagattgaaagaaaaaagcatatttcaaaaatggatcatcagtgtcaaatgtttctttcaaatccaataaaataaaaactgtaatgtctattgtggattcctgtgattctagtaaggtactttgattttcctgtgggaaaccatgccttgcctattcttggtttatttggtttgggttgagtgaattccacccagtaattcccagggtcagtaaatggtccaactgcaaacaattgtgagtgactcctctaagcataggggtggcctgagccaaacaggccaatgggacttcatgccagggattgtgctggaacaattggtaaagaactgaagactgaatatatttaaattttgtgaataatacctttttcttcttaagccaagtagagttgtttttctgtcatttgtacccgaaagatgcctaattactacagaagcaaaaaaatccattagatataatgacaaaggttattggagccctcagtaaggatggtgtcagctgagcggtgctggcagaagttgggggcattctcactgcctcttcatcttctttcttcaactcttaaaacacggttttatctacttgtgaaaggagggaggaaaatgaactaaatgtttagagtgctcctgggagaaagcagaaaacagtgttggcatctcagagccaccctcttctgggcctcacctgaggaacaggtgtgctgcattgggcaggggctgggggaaggttccccagtgcttccagagtccaaacaggccccatctattttaaacaactgcaaagtccccgtgataatagatttgctcttaattttctatttttcccaagtacttaatcctgtgccagtgggcttttattaaatatagattcatttgagactccccacctacctgagcaaggatcagcccacaagaattactccatctggagttctacagtttctttctgatggctgaaaaaaaaactgcattttgattccaagtttggtccttctcttctggtgactataaggcagatatatttattatcagttctgtgggattctttgcttcatcataactctttatatgaacttgtaataaatctgtcatcacagtctcaatttattttcacaacatttctcttatcaacccttctttcctactcaaattattttctagaattcaggtgctcactacttctgcctcgcaatagagtaacaatgctctaattggtcttggtgcctatagtcactctttgctccaatccgtcatcaagcaaataatccccaaactaattaaatgtgccagcatcagttaaagcaggcagtgaaaaaacacattcctaaatactcctagagaatttaatttatgttttctaaggacacattgtctgctgttattagtattagttgtgtatgcttctgtgtttttatttctattcttctcgattgtacattctttgaggatgagatgggttttagtggatctcatttcataagtaaggcaataaagatacattttccataactaattatataccaatatacagcatgtagatattgagtcctacatttctgattatcaccagttaaggaccaaagtatgacgtgggaatattgagctctcaggtagaccacaggctcttgtcagatgcctgccattgctatgctattctcattattttattgcatagatgaggatagaaataaaggtcagtcctggtgccatatttttaaatatatatagaaaatatatgattggcataagcaccattgagaatattctagaaaaataatacttagctattttatgttggctgaaataatattttctttatgagaaaaatataaatttctattgcaagactttttaacaagaattcttttgttttgtttttgcatgatcttaattgagcatttcaaactgttttaaaaattcagagactctctataagatgtgtattttttaataaaccttcacttgagtataatttttatttcccatcagtacctaaaagaaaaaaaaaaacttcttcgaaaagataaaaggatgcatttgcaagattatttccctcttaggaaaagtgcaattttttacagaacaatgctgatacattttcattttattcaacttatagtttaatttttattcatattttatattcatatttgcatgataaaaaggtgccacattgttcttagcaccttatattatttgattgctaaagaaagacacccaaaaaatcaaacaggaataaaaagattcaagtctcataatggagcaatttgcattactctctaatcttcatctcattaaatcttattgacagatcattgtcttcctagtagaaagtctgtgtcttagtcaattcaagctgctataacaaaataccagaaactgcatggcatataaacagcagaaatttattcccactgttttagaggcttgcaagtcccagataaaggcaacagcacatttggtgtctggtgagggcctactttttggttcatggatagcactttttgtgttctcacatggtgatatggtttggacatgtgtcccttccaaatctcatattgaaatgtgattcccaatgttggaggtgggggtctggtgggaggtgatttgatcatggggttggatccctcatgaatggtttcacaccatccccttggtgataagcaagttctcactcagttcacatgggttctggttgttaaagtctaggacctccctcctcccttgctccccttcttgctatgtgacatgcctgttctcacttcaccttctgccatgactataagctttctgaggccctcaccagaagctaagcagatgctggtgccatgcttgtacagcctgcagaaccataagccagaaaaacctctttttcattataaattatccagtctcaggtcatagcaacacaagaatggcctaacatacatggcaaaaggggcaaggaagctctctagggtctcaaaattttagaaggtcactaaacccatagggggtccatctccctgacctaatcagctcccaaggccccacttccaaatgccatcatcttggggattaggtttcaatgtatcaattttgagagggcttaaactttcagaccacagcagtttaagagaactattacttggcaatttttatggcagatccacaatgtcattcaacactttatgtgatattatctcaataacttttggcctttaatattagaataatcattcaacttttaagagaatttggcatttagaccaattaataaactatgcaaaggctctccccacactggctggcttgtggcttggctgaagcactgccagacataggtgcgattaatcatttgttctcacaataaagataacagtttttagaattataagaaaagtttctcattcccatttttctttattagacataaagtccatgtattctcctttttagtaagataattagcaaaaaaatatttctgaggaggttttaaagagggagattatttggggtaaactgggaatagtctgatatataccagcttgctggttgctggtctggatcaccctggcatatgatgtggatgctcaagctttacgactgcactttttagtgaaaataatttgtgccagagctcttctaagcactgtacctgtaatcctccaaatagctctttgaggtaaataggtaatacttattgttcttttacagaggaggaaactgagccacggacaagttatgaacttgctcatggtccctccaccagtgttagagcaaagtcaaaactcaggtctgatcctgaagccatagatctgaactactatgcattgataacaagagcctgaaagaaacagaaccaggaaagggggaatgtgattttcttcttttgggcacattgaaccaaattctctattgtcattatgaatttgtgttcagggcaataaccccaccttggtttattcagagttactgtgagattcttctctgtgttgggtactagattagtcagctcaggctgccataacaaagtactatagactgggttgcttaagtaacagaaatgtattttcccaaaggtctggaggctagaatctgagattagggtgccagcatggacagattctggtgaggcccctcttcctggcttgcagagggccaccttctgtgttcttaagtagcagagagagagagagagaaccagagcaagctctgtggttcctcttcttattagggtactaatccaatcatgaagcccctactgtcatgatctcatctaaagctaattctttcccaaaggccccacctccaaatatcatcacattatgatgggcttcagtgtaggagttttgggggagcagaagggacacagttcagtccataataggtactcatccaagtattatggtagaaaagttgaaaaagatccagctcttcacttcaaagaaataaaaatataaggggatgcataagcaagttattgcaacctgatagttcaaaaataaaggaatatacaagtgtcctgaaaggaacaaggaggatgcaattaattttgtttggatcttgggagcaggatggcatcgaagcagggtctacagaggaagagactttgcaccaagtctggaatatgtgtggttggctcatgatgaaaaagggtccatcagccctactgttccactgtgagagggtggagtttgttacctgtacgatcttattccagaattattctacaaaaacaagaaaccttgtgatattctgggttaggactacatatagtcaccctagagagaaactcaaaattgacaagcattttctgtggactcaagggttctaaccatggttttaatccctcatctttaataatataattcaagggattacagatttttacagaaagcccttgaaatgaaggatagtgacctaaacacagcataaataaaacaaacttagaggcaacagagatggtagagaaacaagaaaagtctaggggactcctatcactaacatcctaagagaaataagagaatattttgtaacatcagcaaaagaatgaaatgcttaaaataatgcaaaaaaaaactacaattgagttcataaaaattaaaaatattacagcagaaataaagaattcaataaatgagtcaataaaatgtttttctcataaagactggaagggaaagaaaaggcaaatagaaaggaaaagataaaaaagttaaaagaatagttaagaaaatccaacgactaaataataggagttctagaaaaaggcaagcagaaaataattcaagaaactctcctaagacaggtcataagttgtcacactcaaaagcttcaatggcttaaacaaatccactgtcggcacatcactgtgaaatttcagagcagttgggacaagaagatgatacaagcttctaaagaaaaaaaatccactggtcaactacagaagatcaaaaattagaatgactttattgactttatctcttaatggttccacagtagctagaggacaatggtagtgtccttgaagttgaactttataaagaaaatattattcgtttaaaatatagaccaaaccatactatcaatcacatgaagatatactaaagacattttcaggcaaacaagattttcaaaaatttaccacacatacacacacacattctcatgaaacacaggaggcttttttccatgaaacaagggaatgaattaaaaacaaggcaaacaaacaaaaaagaggaactcatgagaaacaggaaacaggaaatctcaaataagagagaggccatgggaatccccatagttatggggaaggacgatagcaggattattgctataggtagatgtagtccaggctggaacaaggatgaaagtgtgtggtcaaagatagccaagggctctatattcatagtcactctttctgtcaattcagatgtgacaaaaagaaacttataaatgcagctgttggggattggtagagtttataagagtctgtataaggggtaaacagaggagcttaaggctatgatgaccatccagctgtttgcagactcttggagtgggtgtggaggagaccaagatggacctgagctgaaggaggtccagaggttccactccctttcttcaaccagaatgagtccacctctgcctcatgcatatactttaaatatatatgaatgaacctttaataacaaaaatattgacagtcactactctctattataggctgtcattaaaatattttagatgggaaagtgatataattcgattttaattttagaatatgactttgattccaggatagagaatagattagagggaagtaagattagaagaaaggaggccatttaggaggctgtggtagtgcaaataaggtattataagcttctgaattttaaatagtcactatagggatgaacaaagggaaggacaatatatccatataaaaaacaggtagaataaatatagaactggtgaggcaaagtgagaaagaatgcaaataacttccaaatttctaatttagacaactatgttggtgatagtctatctgctaatattcaaagaaaatacaggagaaagagcagattggtagaggaagataaagatgcccattttgggcatccagtgggcgaagttttgcaggcaggcggatatacaggtttggaattcaggaaggggatgatgatgtatattttggtgtccaaacaacaggtgtttgcaaacatgggtagatcacctatgaagaatatgtaatgaagaacaaaggggcataaaattatggtggatcatgagcaaatatagggtatgggaagttactaaccctgaaatacttggtccctaggaaagactgtgttagaaataaaattagccccattttctttgaatatccaaatgaaattaaacaagaatcatctctggccaaacctcatgtccttatcccccacaaagaccagagtgatggctccagagacagatctcaaggagaaggtggaagctgagagaagtgctgtggcagtggcctcgccttcatggaaagctgcagtacctttcaggagccgattttgctgccattttgtgccatgactaatattgattcactcttcacactccctgttttcccatttacataatcagattcaacaacttattctcatctcagccttgaaaatcaggacatagatttttatgcttcagagtatttttgtggcttgcagaatttcagcagctgttacttcatacatcaggaaacattagcaaattaaagaaacaaagtttgctgagaatgtgtatacatatgtaacaaacctgcacgttgtgcacatgtaccccagaacctaaagtataaaaaaataaataaataaaataaaaaataaaagaacaaagaaagaaagaaagaaagaaaaaaaggaaggtaggtccatagcattagagaatcttatttggagttctgtggcttaggccaactagtcttgtaaattagagcttcactttatagatggtctttatatttaaaaatcacattttccaaaaacatacattattttaggttttgaatttgcgaattgcgataagagtgtttgttttatggttggttactgtaaaatgtctagtcacaaccactcccctggtccccaaacaaaatagagttctcaggcttcctataagctcttttgtaaccttggccccaccaattattttcttattttaaagagaaacctgtaatggtgtcctgaggttacctctagctgttcaggactgatacacttatgaacaaggaaagacaatggaagtgattactaaatcaacatgttaccaaataattgaagatttaaaaaacatctatcatgagaaatgaatcatttttcaacaaaagggtattctttgtgttttctaagctaaaacattagaaacgtcaatttccagtagatgaggctatgttacagtttattccatttataaccctcactgtttttggctattttgttcaggctagaaacagtatttaaacatttcaattgttgtactgtttaaaatggctgcctatatatggaattctaccttgcaaagtaactatctgagtatatctgaaatttgccatcatttatcaactgcccaaaatacgtttttcaatatttcataagtatacaataaaacttcttaagatatcagaatccattttagaaactgaaataatgtagcattactaatattcactttaatagactggttggtcaatactctatgtttaattataattcatttggatccactttacatatgtgttatttaaaaagcaaatcatatcctatcatgtgcccttagccaatctcaagagcaagagaacaggactttcacaaatatgtaagcaatcttctttttatcatcttctgtgttcaaagttaatcctgcaattgtattaatttcccctatgagtagaaagctgaaagaaaaaaaagaataaaactttgtggtttacatattgcattatcaatctcttagtgtcagaaaggctgggtctttttgttgttcatcattctatctgtggtacctaaaatagtctcacgcatgcagtgagctctgagtaaacacttgttgcatgatcgatggtgccaactattggtgcattctgaaaaacatgccatggagaaggtatagcagaaaaagcctgcaccacgaaataggaactctgaagtctattctggtttttgctcttttctgaatgaccttggacaagttcgtgtcccttagagcctgaagttcctcatttacacaatgggaatgaaactacctgtcctgtccttcagcaggcatttagtggagcaaatggggagagctctgtaaacatccaaataaccaaaaagacaaaggaaaacagaatggctgaagagagtgcagatctctcgctttatctcagcagtccatgtgcctctgtgtttacactcagcttttaattatttgcattaatgaagggcagccgaggcatagataatcccaagtacttatgtttggctttggaattaaactgaatgtgctctgtgtaacattttgagagtgtattctcacaaagtcatgaaatcatgctatgaagacccagttctctgacactggctttggggtaaacttgtaacaatctcttaatctccccgggcattaaggatccttattacacccacagccctctgtcagttaagaggcagacatcataaacacggcacatcagcctttggcaaaatttaatttcgcggtgaggattcagtacaagactctttaggaaaccgggacaatcattttgtttacttgtttgctttatcaggcagaaattagttgaggctatcatcggggaactgaggcagtgggtgttcgtagttctgatttatcactgcctggcatattatatgtaaatgcggtatacccattcatatattatgatggttcacttttgaataaatgaatatatcactccatgaagatgttgagtcatattttgagtctttaaaataagtacagtactcgtagcttcccttctacttagtgatttatcattgatgaaacatgggtttctgaaatagtgctgaaataatttatttgttttctagcctatgcatttgttgatttgattagtaattttatcctccctctgcagcaattggctggtaaaactattccttgtaacttcagaaagtaaagtattactcctttctcttccttatgcctccaggctactataattccaacctgtcctacttcgctatggacatatttttaagtgtcaaaatgttctgcatatttacactggagtgtatatctagaatgcaggagttatttaaggcccttaaaaatgcagcagtgatgaggagaaaagagtgacaaaaagtgagagtgaggcccagcccactggagaggcatatcccataatccgctcattcatatggaaattcattatttttcaccctccaggtgcccattttagtcagaaatcatttgtatggctatggaatcacttcgtcactgggcttgactatgccaaggtcacaaagttaaattagtaccacagtcgagaggtaactcaagggcaatttgttccactttgcttgctcttctctactgagctggcctccaagagtcatttactcgagtttgtctctcctgtccccaaaagtggtagtgacctgctttgtgacatcccacaaagagcctccggctctagcaatgggagggtagagtgaacagaactgggtttagaacctcactctggcacttgccagtttctatatcagggttattatatttacctcataattttttgtaaggattaaatgggatgagccatgagaaataccttagagccttacatacattaaactttatttttaaggagcttaatgtgactgactatgccattaatgtgacatagcacctctgcttttgctatcattgtaacaacaagggctttataaggcagaggtgctccagcatggtctgttgcactggatggagatgggggctgcttcttgattgttgtgtaatctattgcgtatatgctgctttctggttgaagggtgagaacaggtttgaccatgcacttggttgcatcctctctggcttgctgatattgtttggctgtgtccccacccaggtctcatcttgaatttttatgtgttgtgggagggacctagtgggaggtaattgaatcatggagacaggtcttttccatgctgttctcctgatagtgaataagtctcatgacatctgatggttctaaaaaggggagtttccctgcacaagcactgtctttgcctgaggccatccatgtaagacatgacttgctcctccttgccttctgccatgattgtgaggcctcccaagccatgtgcaatgtaagtccattaaacctctttcttttgtatattgcccagtctcaggtatatctttatcagtagtgtgaaaatggactaatatacttggtgaatgcctcagggggaggtctgcctgcttatctgacctagagccactcccaagttaccaacttggttggggaggcaacatgacttcctggattgagcactggagcaacaatcatgagacctgggcttcaggccaccaagttccagcactaacgatgagtgaccttggcaaactactttccatttcttcttcccattagaggaaaataattgatcttttggtcataccttacaaagatgttgtgaagatgaatgtagaatatctgaaggagcatcagagggaaatgccaaagtgtacataattagttttacaatctataattaagtatatggatagagatgaggtatccatgtgtgaattatacatttaaaaactaggcttgcttttttttttcctttctaacagtagtgaagagcccaattacacctggtgttatattagtagagacgaagacccagaaaacttcattgtataagaagttcttaatgcatcaggagaatatgataccaaaactgttagtgaaatgattaaaggtaggacagacagtacaccactaaaggcaaaaggtgataggttgttcttgattcacaaagaaaagaaatcaagtcaaaggtagttagatatgaaagattcagggtcttaacccagttctggatgtgggcatattacagtacagtagtaaccagtccactaaatactaaaacacactgagaaaccatctcttcaagccatcctctaagtccacatacctcagccaaaggagatgtctgggagacagaatgtgagcagctgccaagctgcaactcgaacccattcagccagcccagctggggaccatcccttgggtcccttcaggcatcaggagacttctcctgcttttgtagcctttccccaccttattcttctgtatagaatccactgcagaatggcaggggttgatacacatgaagtatttttaccacctttctagtgcttttccagatactcaacacaagcaatttgagtaagctagagctccaaaatttagagtcaatagagaaacatacattattcagttttttgaaagcagatttgaagcacgtacgccatccttccaggctgattatcttcacttcttgggtcagcactcatgccatgacctggcctttcctgctgttttctctctttccacccttcacaatcgagagaaggtctccttgggccatcatgatcatgaggttggtaatgcacttttctgtctgtgccacaggccacctgcttgtttcctcctgaaacttctcttctcacagctcacagcttcttgacttccaaattgataggtcacagttttaacacactgggttcataaagcaaataaagagcattttttaattttctctagctgtttgaatctttctcatgagcctctacttccctgggctggggccaagaaggtgggggagatttaaacttagcagtcttccagtttatttcagtccagatcatctctactgggtaagtagtctgtcggtgtagagtttcactctaacagacctgttcctccctccctctctcttcctccttccccacttggttgctggctataaggaaagcttctcattctcctgatgtcatgatggggaagggtcccatgtctcatataagggcttgggctcgtgtcccctgcactacctctttggtccttgctgtcctctggctggtatctgctgaaacctggtggattcagccttaactaaggagtcttgcctgtgtgcctgttaaagtcctgcctgttgtagctccaggtgtgtttgcttagccaggccatgttcctgggagcccagcaccttctttggctgaatggagctcttgacagtatattccactcaccaaggtctccagctctcactagtaaatttcacctaccaaggtctccaggtcttactagtatatttcacccaccaaggtcactatgtgactctgagaggcttgtccatcagcccttagattcaaggtcacttagcccccaccaaaaggagccccctgaaagctcctcagctttttataattgtccctttttcaatagggaacagaaatttctgatctcttctgtgctgcacgagagcccaggcaggctgaggagcactaaccccagcaccatcaggcccagactggctgagctgccttgggtactcactgaggtctctgcaaaatgcagccctggctctcaccagactgtccaaatgggagtggacaaaaccacctcaactcagattttctgtcaacattctcatcgtgttcatggctcctctctcagtcagggatgagggtcacagtgtctttctaggcttctcttgaaagtgcacgtctcctagaaatcccaaccaccaataatccatccatgactgactccacaattctactctttctcttcccctttgtttagcaattcttgcttattactttttttactagaatcatcgtatccccctaaccttcagatatacattgatcattagaatcttttgaatcattcttccaacaagtagttattgaggtgagctttattctttgtagtggtaatttttaaagttaataaaagcttctacctttatagcacatacaatctagtgagtgacccaaatttgtttttatttccttttttaaaaattacttagtagattagttggttgatgtatttaagcaaaattctttggataccaactatgtacaaaatactttaaaagacaatatgtgaatgtgtttgggagatgattcagtgatgagtaaacactgtccctctcttaaaaagcatatatctatgacacaagacataaataagtgctgtaatggctgtaccattcaactcctatgaagatgtagaagaaagaacaattcattctgacttgaaatatttcagaagaatttgcagagaatacagaattttatatgaacctttgaagtaatgcaaaaggccaagacaaagttgagttatattttagacttgagaaatagaattacagacatgaataaggcaggaaagtgcatgggaaggcgtaagaaagggtattgggagcaagtgccctgtgctgcccaaagcagagagtgatttgatgagtggaagaagagatgaagttgaaaatgtcagatatgaaggctttggatatcatattgagtttaggctttctttaaacagtggttcttgagaaggagagtggcatgatctggcctgttatttaaaatacagcttaaggaataatgagtttgaagcaggaaagatacttacttgtctctattactctattgtagtaattcaggcagtaattatgagaagctgagatacagaggtaggtgtcgaaatgaaaatgagaggtcaggcataagagacagcagtaggttcgattgacaatataggatgcgatagtttaataagcagctgaataagatgtccaagagttttccactaggatgttggggagttaggtgacactggggcagggagagattatgagacaatctactacatctgaatacccactttgtgtaatatcttatactgacaattctagggttgttcaccctttatctctgcacacagggatagtgacatcagaactcacactcccacatcttaatcttaaacagtgctttctatataacatcatctccctacttcttttctgcttttttccgataggctcacaaaacagcccaagtgaatgttgtgggacagtaatacaaaagaataaaggatctgtgaatgagtccagttaaccatgtaaagcaacagtgcgtgatgcccagatgatcctccatgagtatttgctgattgaataaattcaaacaattccaatggatcttaggagttatatggagcttcctgcataaccctgaagagtattgcacaggatgaaaaaaaattgatcttgttggagatatattttccttacttacattttcactatttttcatcatatatctgggccctaccctgaataccctgtttcctctgttacaatgagtgaaacatgcatgatctttcccaaggccaacacctctatttcctggtagatcccctttctcctagcagaagcttttacctgtaagaatttcacctctcacttctgaatccacagtttttcctctatactagatcactttgattaagtatcaaagtataccagatcactttgattaagatggagctataaaagctcccatcttttaatgaacaaacttcccaatctgctccagtttgaggttcagccagcacccatttctctgtgccataacagggtttagacccaccatctgaatttcctgtgattccattttctcctgaacccacccaaatcaaaccgtctacctccctgtcctctgaaattgcccttgtcaagatctcctcaacctcaactttgtgggaagagggtacaataatcaattatctgtcctcattctcatcagtctcttaataacttttcatatagtggattcctctctcatttttgatacattttccttactgagcttctgtgaagccctggaatcctgatattactgcaacttcccagccaggcactctcagtctactgtaataaaccatttccccttttcctgtattttaagtcatattttctcaaccagagctccccagaacatgagattgtaatgccggaaggattccactcatgttcttctcccccctatgcatctacagtgtttagataacatacttgggatgggacaaagagtcacttaggtcattttctatgattcagatcaagaactccagctgagaaagaatgctctaaatgttgatgtcacctaaaattcagtccttggcccttttctcatctctaaatatccttatgacttagatgagcttacgctgacgacatccaaaacctctatttccaacctcaactcttcttttaattctagagacttttgaaatttctacttgaacttattctacgatcttgtggctcaaaatgtgttactaaaaccaacattgtgagcacctaggaagttactggaaatgcagaatgtcaagctctaccccaaaactgagtcagaatctccattttaacaagaactccaggaaattcacatgcacatacacataataggtttaagaaacattaaagtaaaacatctcaatcttattatctcctaagcagactatttattcttgtttctctttaatgttctaagagactcttggtcaaatttcccttctatcagtctgaagccctttcatagcttactgcttatttaggccttatgtaagacaagttgtaacttttgagtaaaagagatttaccataaaaaaaaaaaggagcatacatttcagagccccttactgtacatgccccttccaagctgctgggagaggtcccaccaatgtgttcacactatcacctgctttgcataatttgccaaaatcatttatgcaaattaagaccactttctcttatcctttccattactgtcacacttctgggtgacaagatggcactggagtgaacgtgggcattttggtgattgggccacagggaaattaagctgagaatgtattcagttttagtttaaaggggtgtatttatgaagttcatagatcattcttcatatagccttcccagtataggaatggcttccaagaatagtctggtggcttcctgtgccctctcccccagcatcctgatacagtgatgcagggtcagggctcactatgatgcaaaggtgtctatgtgcccagcaataagtttccatgagtaggggaggaggataatgttggaaggatatggagctggaagctagtctttcaaacgtttaaccatcaaaccacatgattttctacggaaattatgtgacatggaatttatcagaattcggctgggcacaatggttcacgcctgtaatcccaccagtttgggaggctgaggcaggtggatcatgaggtcaggagttcaagattagcctggccaagatggtgaaaccccgtctctactaaaaatacaaaaagtagctgggcgtggtggtgggcgcctgtaatcccagctactcaggaggctgaggcagagaattgcttgaacccagaaggcagaggttgaagtgagccgagatcacgccactgcactccaggctgggcgacagagcaagactctctctgtctcaaaataattaattaattaattcattcattcattagaactcctgtgcttgtataagttctgtaaccatacacacagtaaatatatgtgtgtgagaagacacattttatgcattccaactataaactttttcaaagtttgatcaaccatgccaaagtaaaaacagaattatctttatatccaaatgatatgattatcattttatgttaagacaatcaaagtctacgtaaccaaaaaaagtatgaaaaagcattacagagagatattgggcagtgcatttatgaaggaagattatgtatgcatattttgttatgtttgtagttttatcagctttaaatatctgtcattttgtgatttttttcttatactaaataatttctcattttaatttttgtatgtataattatttatcccttaccttgaagcctcaggtaacgaaggacctggttctgtcctgggttattgttctaaaggaagtcctaacactatatttatgtgcctttctcaaaaagataatttttatattatggtgccaaatagaactttaatgctaccaagttcctacaaggaatccttatctaaaaattgttccagctccttaccaaaggaaaggaggcttattcatcaaacccacttcaagtgaggtgctagatttgattgaatgtcatcactgccaatcctttctttcctctgatgcacatgcccaattacaacctaaattccctctatctccccaaaagaggatcctgtaggatatataaaaaatttaactcctatcaaaggtcaagtactgtgttgttagtgagtaagtaaagaataaagtattgagtagaaaatacagagcagcacaccgcttttcatgccttgaagtggcaattgaacaatgagaacacttggacacaggaaggggaacatcacacactcggacctgttgtggggtggggggaggggagagggatagcattaggagatataccaaatgtaaatgacgagttgatgggtgcagcacaccaacatggcacatgtatacatatgtaacaaacctgcacattgtgcacatgtaccctagatcttaaagtataataaaaaatatatatatatttatatatatatattctttatatatatattctttatatatatatctgtatatatatatataaatatatatatatataaagaaattcccactcattgcttacattagcagaaccaaaaatgaggaccaacccacagatgtgatcgccacactttatgcagtaactcagattaggagtcattcttatccttcttttcttatcttcacatcctatgcccagttcatcctcgattcaagacaactctaccttccaaatgtatcatgaagcagaccattaccaccattcctgtctaagccatcctcattactcatctgttgcattagcctccagcttccatgctcgccaccccgctggtgctttcctcaccacatccacagtgatctttctaaaaaataaatcagatcaggccatcctatctaaaaatatctgggactttccttcaagtttagcatgaacctcaaactccatgcatggcctttaccgcctcacatgatataccctgcctttgcaccccacctctccaacttgcctcttttacaatcatccacccacacttactttcaaggtgttcctccaggaaactcagatattcctgtctcagggttttaccaccaggaaacagctattcctgcctcagggttttacagttgccattccttctgcccccgcatctcctctgtcttcccattcacataatccagatttgggctccaacattctcttctccattagaagatgcccttgaacaccctacgtaaatccaggccccacctcacacacacatacacacacacacatacacacacacacacacacacagtcacattggcattctctgcctccttggtgtacttcattgtttttcacagcacttgtgtccatcacaaattgcatttctttttctcgatgcccttcccatgaaaccataaactccaataaggcatggactttgctttgcatccccagtgcctagaactgggcctaacatcagttctgtactcattaaatatttgttgagaaatggaaaggatccttaaaggctttaaaaccttttggtattgtctatgacatactgataaaaggaacaatggaatttttagtagagagtaaattatttttttgaatttagaacttagattttaactatgaaaggaaaattcaagaccagtgctgacgccttctcactttctgcccagagttctttccattacaccatgcatgttgtcttcctaaatgatacgtttcgtaagaacatgcttattcaagattccacactgcgcaatcatctatgataacacgtctagaataaaaattacaaaattaacaccacatcaccctgactattgacatgcctaagcaatttgcttaaaaataaacctgtgaaaggtgaaggaaagagatataagcgtatacttattaattaatcaattaattatatatgtattccttaatttaaaaaatatttttaaaattttaatcagttcatagtaaattcattcattttttaaagagaatagtcattataactaattgtcaagttttccttcaatctgtctataaattcaggatggtgcctcttgatagcagtcataacaatgacaaagtaaatcaatagcacttatttttggatctcaataaatgcaactaattctgtatctaatcctagactaaccattttctgttccttggtaatcagaaaggtctaccactcagatctcccttcaagatgtccctggtcatctattatcaaggagtactgtaagctgatcgtctcatgcaagatttgcctcatcttttaaggcaaagcctcactcactccagggagtccccagccaatgactgagcatgactgggatgttaacattagccacttctgcccaacacagaactcctccagtggacaattcctgctttagagttccctgttcatttgacctaaactttatgagatctgcatttccatctgaaggcttttcgtcctcaattctgcttccttcctcttttaccttcacaggcattaactcctaataaacctcccgcactcctaactttgcctcagcttccaagaggaccaaaattacatcttcatggcacatggtctcaggatctcttgaaactgtgacccaggccatggtcactcatatttggctcagaataaacctcttaaaaatgacacatcttctaaattattttattcatccatttaggggaaaggtattttatcaaatgactttttacataatgtgtaaccatgttagcatgtataatcatgactacacaaaaaaaacagtacaaaagacactcattgccaagttatgtcaaagacctaagtggcttcacaatctatccacctttttcttctgtttggcttatttgaatgaccgtgcttttgtatccttccatctggggcagtggcatggtgagggctgtgttgtgatggatggggttgtcagaaacccactgagtatttagatactgcatgagtgcattacatttacaaacagctgcatgacaaggaagtgtgattgcctcctcttttatgttcttctgcatgttaaggaaaccagctactgactggagagtcacttgatttttaaaatgatatattttcctttccttttcctcccaccagttttgtgcttcttgattatagtggaagcaaactcccaatgtttttttccacaaaagttttagtctaaggatgaaatatatgtttttcagctagtcttggataatccagattagcaaagacaacacaattagaatcaagtctataccataaacaacaacaaaaaaccattgacgagaagagacatagagaatgaatacttattataaaaaacactgtaccccatttcttgctcacggattaaagaaatcagccgttctctcttatgaggcccattttttattatgtgtgtgtggcttcaggggctcaatgtatttaaatgagagaacaggacaagcatgggagtccccaggcattttcctctacttgcaatataaagaacatctaatcatagacatttcctttaagaaattgtttctactcagtacccgtgtcttgaagaggataggttttttatccttgagatatacatttcttgacccaatactttacacttccgacacaacgaagaaagcagttaccatactgttaactcctttggtattctctatttggggaggcagggatgtaagtaaggttctctggatttataaatactgtagtggaaatgtgtgctgcgttggttggttagagagtagtctcttcctaataggccccagttttcttttgtatatggccttttcaccattgcatatggtccccttgggaaggcagttcaggtgctcactagagaaggtaaaagagaccaggttctttccttcctgagtaagcaggtgaccaaaaggaattctcttctgaggcttcaaaaataggtaagtaaagccttgacagaggcaatggtggcagatttcttttaaatccctgtggtatgggggtccaaaacaagttaaagtatggaaatggatttctgtttcctatttttatgtacacatacaagcacacacacacacacacacacacacacacacacacacacacgtatacacaggcaaaacccagtgaggtatctgttccagtcctcaaaaattgaacatttacagtgaacttgtgtgaaaaaatagtggcatgacagatgtttttatgtaaaaaagaagctatatccagtggcttcccataaattcctattgttttatttaagattctcagcacttttgaaatggtttagcatgctgtcttcattctcacatatttgaaactcttaagtctgtgtgggagacaggtctcccaggatgagaccagatgagaacagaccacctcttatcctacttcccttgatgatttgagattttttttttgagagcctacatgacaacgttttcctttgaaaaaacttgtttatagccaagaacattctgttatatccttcaggcattcttgacaaacaatagtttcagatttagatgcttaaacataaaaacttagtgccgagattgtattgacttgagaatagagataagtaagcacaataaacatctcttcttcatgacatcagaaagttgcttaaagtgttagaattattttaaaagaatgaaaatatgatatttttctgggtaatttaatacaaggaaactatgtactttataattttattactttcctagatttttatttttaaaatgaggaaataaaaattaatgataagtgccctttgttttccaagtagtataaaactaaactaaacttaaataatacagaaggatttattagattggggtgtgtgtgtgcacgtgtgtgtcacacatgagtcaggcttcaggcatagtttgattcttgggactaaattattactggggttctgtctctgcctctttgaatttgtcttggttttttttcctccttctatggtatgttctttaggatagcttcccacataatagaaaaaaatgacttcagcagtcccaggtgtgactgtcatacccacatatcatctataggaagttaacttacctttgtcctccaactccaagaagaagacctaggattcggtctgactggtctggattagctcacatgcccaccggaaaccaatcactgtagccagattgctgggatgtgctgattgacttgtgtaggtcatgtgtcccatctctggagcaataatggcctcagcttctctaaaaccacatgaatccctaaaagaagctattgggaagtggaaaatgcagaaaagtacacagctcaggcaaccaacaagtgtccagtcacctccattgtatttccactgtaaattaggaacaagaactacagctagatgtgtggttcaaggttcacccatgccatccatcactttgtgcaacagctttggtgtgtgaagcaacagaaagaagtcatataatggccagggaaaactattcattgtggcttgtccctgaatgtctcagaatgttggcctcatgagtgccctagaagtattagaccaagaaacactaatcctcactaacaggacttatgagactctgatgtagaactcaaaaagcctgttgatccaataaaataaaaacatctttgttttcaaagtgactagatacttgccagctatgagaaaagccacattattatcagaaggatgtttactatacttggaaccaaaagaggcatggttagttttatatttcaaatatttatggcatcaggtcattatagtcagatgtcctcaccttgtctacaagatgtgagtggatgagtccttgatcaggcacaggcttagacaggcactgaccatgtttgcctcattgtctcccccattcctaggctttatggctgctaataccttttcctgaatgactcttttattctctagataaacttaaaccttaaattaagtctttttgtctaggatttactctatctctttatattcatagtatgtgtccatttaaagtttaattctatacagtcaattttatctaaaaaaattgattttttctcctatataccatgtaaatgtcatactttacaggtttttatagaattaaatactttaatacatgtaaatggaagtaatacctgttgggtatctactatagccaactggtttactggtcataacacatgccctatgttatcttatttatactttgcaatagccatgtgattttacagaaaaagatactaatgttcaaaaaagtctagcagctttctcaaggtccaacggttagtaaatgatgaggtgggattcaactccatctttgtctgattccagcgtcagaggtctatgcatgtaaacactgtggggaaatattaagatcaagtttgtgtttctcacaattccttattaaactgctgaaaagcaaaattcttcatgtctaaagacaatggcaattcttaattcattatttcaaatttaattgaaaagtattaatttagtttattttttctatgcatagagtaaacaagtccctataaagcagaatgtacagtaatgaccaagaaaccatcatgaaaacagaaaagagagaagtgtttcaagaaaaccaagggtacaatctttatgacttgccacacatgaaaaaggaagggaccaaagagatggaagagctaaagtaaatagcagaatatctacctagggtcttgtctctcttaggtgacctccatagtgtcggggagctagctatagtcatgcatcacttaatgacagggatacatcctaagaaatgtgttgttaggcaatttcatcattatgcagtcattgagtgttcttacacaaacccagatggtagtgcctactacatgcttaggctatatggtatagtctgtttctcctaggctacaaacctgtacagtatgttactgtactgaatactataggcagttgtaacacaatggtaagtatttgtgcatctaaacatattcaaacaggaaaagtacagtaaaaatttggttttataattttatgggactgccattgtatatgcagtccattgttgacagacatcattctgcagcatatgactgtatttgaatgtgttgctctctggtttaaaacctagaaatcacctgtgaattacctctggcactataaaaaataatttccaggttctagtggaaggattaaatcagtcttttgtttgttggtgtgttggcagggaggggacttatttatgaaaagctctcgatgttactttgttgtgaagttatgcagccagggctaactactggggtagagaataatgtccacccttcttagcaaacacacacaaatgcctgcaatctgaacctcctccacctatcgctctggccacatccagacatatggaggaactcaaaattccccaaataagtcggactcttgtggcctgggccttggctcatgctgtctgtagacctggaattcctgcctgctgcctgtctgccaggtgaacttatgcaaaaaacagctcagcagtccttgtttatttcctcagaagcagatgtaactgttaccttctttataagatcaatgctatttttgcaaacatccaccatcctgttcttatttgtccatgtgtcagactccctctactaatgaagctctttgtgcccagaactgccacaatttgcattaattaaatgaatgattgcaggtatcctgcttggggatgggggcgagagaatggtatcactgttgttagaaacactaaacgtaataaatggcaaggaagtgaataattaactacttaattgcaattaaaagtttctggtgcctggctataaatttgcttaacatgtggaggggtagattttgattggacatgatcagctagtaccaggtggacaatcaggcagggatgcccagcaaatctctgtaaatggggagtgagctcagttgtagaagatattccaatgagagactagccggaagggaagaggcattaggattgtgaaaatcctttaaaattgttacctactttacagagaagaacagatggtcttgctctgctgcgccaatcacaaaaccgccacgtaaggataattaaagtgggggacaggtctggcatccagttcttcagtcaacattctcctccccaaatcttagactaaattgtaagacacacaggcgtccacatgaagcgtctgcacaggcttccttcaagtgctgaggaacagtgtagtctttgctcagcttttgtctgggagcatggaagttaattatatttttcatgttaatattttggagtttcagtatgaccctctgcgaaatgaggttatgaatatgtaacctacctatcttaaaggattattacatgcattaatatatgccaaagagctttgtagactgcaaagtgatgtaaaaattagaagtgattttttcccaccgtagcaagacctttatcctgtgtcaattcaattacattgccaaatatcactgatttatgctcctttattcatgatctatacacccatatttataaatcactatgataggtattcacaaaaataattgaataatttattgcaaatcaaagttaatgctttttcttatggccttctatttagacagagtatatgcatttttcttctgactaaagcttgagaaattcatccaaactttatggtggcctgatttatgcaggtgatggaaagtagcaagagtagggcaaccatatttaaaccacccacaccagtggtatgccagacacctgtggaaattccatgctgggctttgagggctggggactctaagattccagtgtgggctgggaaggaagaacacctgaaccagcagctattgttcccctctcttgctcactgacagctgcaaggtacactttcaggaccaccaggcaatggcatgctggtggcagaggaggtgacactcacctcataggaagttccttataaaagcaggtggacatgtcatctcaggctcatcaaatctacctgccatcatagatagaccacagccaggccaaccatgccttctagtatggaccttgttattttgagtttgcttttaaattagaaaaggggatttatttgacattgttttctctattatcctttatatttatttaaaatacccacccacaaacaatacattccctgctattctgttccaattattctctgaagaagattataagcaaaagagcagcttttccataacattcaaaaattgcctcttacatgataggcaatgagctagatttctgcaggaaggatatttcatttaatgttcacaaaaatcttatgaggtagctaggtaacattgatcctcaccttacagaagctcagagagagtaagtaacttgtgccaagatacatagttagcaagtggaaagacagaaatttatacccagatctgtctgactccaaagaacacacctgttagcttagaacaggacagatattgaaagtatactatcggccaggtgcagtggctcatgcctgtaatcccagcactttgggaggccgaggcaggtggatcacgaggttaggaggtcgagaccatcctggctaacacggtgaaaccccgtctctactaaaaatacaaaaaaattagctgggtatggtggtgggtgcctgtagtcccagctactcggcaggctgaggcagtagaatggcgtgaacgtgggaggcggagctcgcagtgagcggagattgcaccactgcactccagcctccgcgacagagcaagactccgtcttaaaaacaaaaacaaagtatactatcttatgggtcaaattaaattaccaaaggtttaaaaactaaaaatatctctaactttgtggttaagttatatgaggtttatgtatccataacccaactgtggtgtagtatattaataacagtctttttttttttttttttgagaaagggtcttgctctgtcacccaggcttgcatgcagtggcatgaacatggctcactgtagcctccgatttccaggctccagtgatcctcttacctctggctcctgagtaactggcatgacaggtgtgcatcaccatgccaagctaatttttttttaacatttcttctagagacagaatcttgtcatattgcccaggctggtctcaaattcctggtctcaagcgatcctcccactgcagcctcccaaagtgctgggattacagacgtgagccactgcaccggcccaatatagaaatttttaagtatgatgcataagtgctggggtcttgtatattttttggtttgttttgaattttttaaatattcaatcggtctgatttcccaggaaatagactctgaaatggacattgtctggaggactactgaggtgcgttctcagaaatagcacctgtaaggaaggtagggacgcagggttagcagagatctgagcggtgatatatcaggttggcaaaaacaacaattacttttgtaccaacctatgattcacagtagataataccttgtgccatcctcggtgaactcttcagctggcattaaccttcagagtaattcatcaaggcaaggatgctgggcctttgcactctcttatagagtattggatgtgagaagggggcataactcagggatacactactttcttccacagagggcaattcttggaaaaggaccccattgagagctatgtggtgcagtagagatagcaagagtgctttgatcatgacaaggccatgggaggctcattgcagcatgcactgtagtcccctgtgtcctcagggtccacttgaatcatctaatatgttcacctaatatggaaccagctccaggatgctggatgggctcatttcctggggtaactcataaaaggaaggtcagtgaggtaagcggcaggctccatggctgcactgattctgaggtcacaccaaaagctaattatatgccaatcttaaatcctctcacttccgctcttctaggtgatttacctggtagaatgacccacctgtgcatctctgatgtctaggactcctccttaggccatggtgctacacttgaagatgtacccctaacattgggcctaactacaagatagtatgtccccctatcccctggtctagctaggctggtctctgttgtggtttgcatttctttatttgactcgattgctagttttactccctttctgagtccaaacataccaagattcaaattcagtgagaaagcttaacacactcagtaatatttctgaagtgtctaccctagactaggtccctcactgatgaccacaccataatctttgggagctgtgaatatgttattttgagtggctaaaaagactttgcagatgtaataaaggttagggaccctaaaataggcagatagtggagtcatttttctcttctcatttcctttaatgcttcttctgtgcctttgctaagatgtttatcactttctaccttgaattataggcactgaggtatcagttaccttctctaataggctgtaagaaacttgaaggaagaatctacttctgccttatttgtgctgcagtgaattacactgggtagacatttttaaaaaactgtagattgagcttatgatatcatgcaatcttcgaaatagatgagtaagagatttgatacgggctgctcaattccacccaatactgacattttgttctctcccactcttactggttgcataataaccaactatcgaatagcttcttagatcattacaatattaataaagttcattaattaaaatggcccaagtcaccaagatgaatattttataggccagtcatttcaaacatattagtaccatcattattatatattgatgttatattgataatataacatcattatattatatcattacattgataatatatcatattatattgataatataatataatgatgtattatatattatcattgaataatttatcaaaaatatctagaaaatagttaatccatgctatataaatttttttctattaacctaggtatatagattgttgaaaacattattttgagttagtgttgtgatttatcacataacacatgaatactaatttagctaataaatgtgtcatgtatctagtgaataaggctggaacacaaacaggacatttttgtaacattccataccaagtggtagctcttaagatatatgaaaaaaggagcaacagtgccttgtggtaaaggatgagtaacaggccagaaccagagaccttccagaaagagataattagagatcccagattgggactgacaagtttgaaagccatgctgttcaacccagacaggttgagaacagagaaaatcatatattccaatatccagactaatagcagcaaagaggtcatttgtcagaattaaaggggcagcacaaaatggcagaagagtagatttgaggattcactaaaaatgggaaccttggaaactgaggccatttctgacaagaatcatcatatgcttcccatacagaagtaagcaaagcctaggggacacatccagagtttgtagtgggaggtgaaagggtgcatctagcagacgtgagagacaataggacagaaaaatggccaactctttgcagcacagtaagtagatggatcctccaaagatgacctcatcctaatatttgggacttgtgaacatgttgccttgaatggtgtattagtccattctcgaactgctataaataaatatctgagactaggtatttataaagaaaagggatttaattggctcatggttccataggttgtacaggaagcatagcagcttctgcttctggggaggtgtcaggaaatttggaatcatgacagaaggtgaaggggaagcagacacatcttacatggccagagcagaagggaaagagagagagcaaggaggtgctacacacttttaaacaaccagatctcatgagaactcattcactatcatgagaatagcaggggtggtgttaaaccattcatgagaaaaacctcatgatctaatcacctcccaccaggccctacctccaacactggggattacaattcaacatgatatttggggtggggacacagattcaagcaatatcacatggcaaaaaataacttcgcaggtataataaagttcagggaccttaaataataatcctggattatctaggtgagctttatctaatagtcacatgatcctttaaaagcagagaatgtcttcagctgggaggagagattggcaagatgcagttgaaggggaggtcagatagattgaaagcatgagagggacttgacccatcattgctgactctgaaggtgaagaagacctagaaccagggaatgcaaaagcctctagaagcttagagtaaccccgggctaacagtcagcaaggaaacttggaactcagtcctacaagcacttggaactgaattgtagcactaaacgaaatgagcctggaggtggattcttctcaaagcctccaggagaaaaacacagccctgctgacatgttgattttagatttgtggaactctaagcacaattccagccaaaaccatctgttttcctacctgcagagctgtgagatagtaaatttgtgttgttttaaaccattgaaattatgtcagttgttatagcaggcatagaaaactaatatagatagtaaaagacatcttataattgacccattcatgacttaaaaaggattttgtctattagtctctcttttactttgtttccctgtttaaaatattaaaatgtcaagatactgggaaatttagtattatgctgttatcagaaatgggacaaaagtgacttcattatttctttggacatactctgtagaacccttacattatatgataggattttctaatgtcttctgccctaaaattcagtaaagaaaaatgtaatgcgtgatttgaaggctggtgtgtgtgtgtgtgtgtgcactttaatgtctctttacaaaaatgcttcaccaaacttttatactaaatcattttgaaaaataattatccactcagttatataaattttccttgctgatttttatttaattgtaaccaattttgcttccaattatagcaattggtattgtacaggaaagttataaagataagtaattgtttttagtgaatcgagcaacctcatatatatttttgagatttccttcctatacttttatgagacagtagcaactgaacataaacttttgtaatatgaaattaaaattagaattatttcaataagggagaacagcaattctggtgactatttagccccttgatgttgaatcatgccataccacacctgaatcgtcccacttgattagagcaaccattcaagatactcagtgccaatcctgtctcaataatctgtacttgctctgaatatccatttaaaaagtggataaaatgctaataatgctttagaaattgtgtttgtaactgcagtgttattaaatgatgccttagactagatgtattttggaaagaactttgagattattgaatgagaggttatagtaaatgaactttcacattccctttcccttcctaaagaaaaaatattcatttcatggatttagtctacctttgagattcttagtcttttctagggagttctagacatagagttgatactcagttaatttttcttttattctcaaaaacataggctttcaaatttaatttccttattttttcagattgtggtttaccagtaaaactattctggagtggtataagaaaaaccagaccgtgtggccatttatcttctttttgattcaaagtgattaagtgggttgaaggcaggggagatggactttcaaaacagagtgttagaaaatcatgttatttttatgtatttgtttaataaataagtttatgtatataaatcactaaagggaaaatcattctaatgatcttctatgtcattagaatatgactttatatatactcccagataacatacttgaatattggtcatgccgctttataaatgtataatcttgagtaattatttaaacttatcttggtctttaaaattaggattataagaatcaggctcaaaactgctctcagaggcaggctgcctttgaagcatctgctttcttagacaaattaggagtttcaaatgaggaaagaagaaaccaggtttttaaagagatagaaagtaggaaaatggtggataggaagcaggactaaattgcagctcctactcggagggacagagtagcatgtggagacacatcatgaacttttgctccaagaactactgcaggaacataccaggaaagccaagagaatccaccaaccctttgaaggaagcagattgctcctggacccggagagacagcccaaatactgtgagtgtccaaagtgtggaagtaggaaaaggggatcgttcccccttgaacacacaccctcactgggaaacctaaagatccagattacaggaaggacttgaccttacctggagatgagataattcagagagccaagcaaaatacaggagtagaggaagcagcaggaagagctctgtgggctctctcagtccccagggaagccatttctggtctcacaggggtccttggggagggctgccaggggaactgggaaaagaccacaggaagaaggaagcctccagctgaactctgtaacaattccaaacgattgcacagtttcttggacagaacgtgggggaggggttgaatacaaagtgcagatgtgggcaggtggggaggcatgaaacctgaaagctctgcttgctttctcagtcaggaggctggtagcctggggtgctgctcgcccactgcctggaaacgaactagatgcttttgaggtggagggtggggagtgcaatatgggagtgagactggccttttaagttgcatgggagtggggtgatgcctgtaactgccagctttcccccacttccctggcaacctgcattacacagcagaggcagccataatcttcctgggaacataactccattgacctgggaaccacacccccatccctcaaagcagctgcagcaagccctacccaaggagaatctgagctcagacacacctaactctgccccaacctgatggtctttctctacccaccctggtagctaaagacaaaagccatattttcttggaagttctagggccctgctcagcacctgatccaatttataatttccaagtagtaatttgccaattatgtgtcaggttttgtttgtttgtttttttgtttgtttgtttgtttgttttttgagacagagtctagctctgttgcccaggctggagtgcagtggaacgatctctgctcactgcaagctccacctcctgggttcatgccattctccttccccagcatcctgagtagctgggactacaggtgcctgccaccatgcccggctaattttgttgtatttttagtagaaacggggtttcaccgtgttaaccaggatggtcttgatctcctgacctcgtgatccgcccacctcggcctcccaaagtgctgagattataggcatgagccaccacgcctggccactatgggtcagtttttaatgatactcgctgttgcttcacaatgcagttggtacatgtctttatcaagttaccaggaaaacaatactaaggagttaccaaaggtcaaattctcatgcagcaggaaatgagatattattagctctttatgtgcaaggagtagctagtttattgagaaatcataatgtgttagggtataaaaataaaactatgttattatttgtcagtaagtgccccaaagtactctgttgaatctcacctttcacacttgctgggtgagcttcaataatagaatcatagctataatcttgactttcattcatttattaaaacagtcacttagagttcttaaaacccagaatctcataagcatttcataacccctctctccttctgccccaccctgagaagatggaatgaaaggggatttggtctggctctcacaagcttttccctcacatgtattgcccacatattggcaaaaatgaaagagatgaagtaaagcagctctaggaggcctccctgaatgaggaggcagttcctgtctggatggtctcgctgttgacctggctggtgcatggtttgacaaagatggatggggtattgtcaactagtcaaggctcattcttagctagtctccccagtattagtgcttccatgtgagatttagccacatcttctgcccaactcccactacaaccttaccttgcattcctctcaaatacagactgcagccaacaatctcatcagacatccactatcaacttgaggtccacaggcctgttcagactccaccttacatattagaaactggaaacccaagaatattcaagttgaaggttgtgtgagactcaccttggcctggcagaagccaccatgccatctctccccagtgttttcattccctactccaccagcacagaaattctggtgtcaatgcagatgtccagctagggaagaagtgtcaatttcctcttcttataggcacatctaactctaatgagttattcttttcaggttttcctttcttagatttggaaaaataaagtgctcccttccacaccctaacaaagtctgttctcctgacaaagcggtatctcttccctttccatgtcaccttgttagtctgagtgtgtatggggagtgagaatattgggacgagaaggatgtaaagccatgctgctgagacagtacttctctgcaaaaccggatggggcatagctggctcaaagctgtcagatctatgagagaagaatataggtctacctaacacctctgttctcagatataaattagggttatgggctgaattttgtagccccaaaactactatgttgaagccctaatctccagtagttcagaatttgactgtatttagagacaatatctttaaataggtaattaagttagaatgaggtcattggggtgggccctaatccaccatgattgatgcccttatgagaaaaggagattatgacacagacatgtgcagaaggaagaccatatgaagacagcagaagaagatggccagctacaagacaagttgagagttcctcagaagaaactagccctgtctactccttgattttggacttctagcctccaaaatagtgagaagataagtttctgttgtttaagcccctgagtctgtggtatttgttatggaagtcctaagagactcgcatagtcaggaaggcaagagcctgctgtacacataacatcccatgttcaaatgctccagaagacagtgttgccaagttgttgtacaggctcttacctgcagcaatggttttctgcccaagaaggcttaggttaacattggcgagattcatgacaaaatagcaggtaggaaagggttttcatattttctctggggaatatatagtttaaacttaccagagctcaagggatcaaactggattcaagaagactggaacttgggtgagatcttctgattggtctctattattatgtcacttggtttagaaaaaaatgatgttaaaagggttcagtcctcattttcagtcactgatttgtaaactatcctcccttttattcagttttactatctgtgtattcctcacaactgaggaaagtgattctaataagctataattttttacttctgaaccacttgcttggttcattcatgttggaaaagtaatcaataacaatcattttaaataaatcacgaggacttcccttattctttccttttaacaaagcaagttcaggaaaattaattcttctttgcttattcttttagtcaagtagggaattttatttttgtctaagcttcattgctacggatagtcacagtggcattcaaatacttgccccaagaggtttaattgggatgttaatagaatccatataaaagaagttacctgcaaaagtgtacatatgaacagttaagtttctctagcaagtatggtgtggaaaaatgactcattctgactgcgcaactattaagtcttttggataaagtgttctcagataattggcagataatttaggtcaagtatttcttgtctatatgtctaatcccatccccttcctgttttctctctccaaagctttcctcatgaactgactctatatctgtatccataaagttttaataattagttacatttttttaaattaaataatggtgattatggaagccatggtcagatgccattcagatctcctttcgagagaaatctgcattgaagaagtcagttagttgacagcctgcagctaccagtccttcaggacctatcacggcttactctccaaggccacgttctccccagtctgctcctagcaaatcactgatcacagcaagggcacaaaccagactatttctgcctaatgaggtcttcctttagcagaccatcttgcatcggtctttgttcagaggtacaaggtgatccaaacccttcaaacccaactctcctccttccttctctcctgtccaaggtgtcagacctatattgcgtactgaaaactctccctgcctattcctactctcctgtgccttatctttcacccattttcccaatttattctcttgcatttttggtgtctgcttcacaaaggactctgcccagtgtgacaatctctgtacagcctgcagaaaaaaaagtgtttttagagaaaggggtagagagatactcttcaccactactcttactgcagcaaaccattaccttctgggggaaacagaagggtgtaatttaatataagattccaaatctagggttttttttaaacatttaacactagaataattaatggaaaatagatgaagacagtctctcaaaataagcaagttaatcccacttttttcatttcgagtccatctttttattgcccacaacactctcaactcaattacatcttacttcaaactaaaaactaacatccattttcaataactatactttaataaacacatacccattacttcttgtgccttatatctccctgtacacaaagaacattataaatatattaagtaaacaaccacatgcatatgggttaattacttagcacaaaaactgcaagatcccttagagatgtcatctgtatgacaggattggtgtttacccaaggctaacagatatttagaataggaaggtaacaaatgcaatttaatcagtgaagagctctaatttacttgtatcaaacaatataattacataaggcaacataagcataaagtttcctatgataataatgattatgaaaaggaagaggaagagcacatcagtttttactgagtgcattttacataaattttctaattattaaccaatttaaagtgcaaactccatcacatgatcacatttgaattgttcaggacacaaattaaacttttctcattagaggaatatgtgtgttttcatttcaaccagcaaaaaacagaaggaaaacacaggaatgtgaagagttaaaaatgaaatgttcaatctgttatttggttagtcttcaggcttcagaacaaatcttcaagtcccctattacactattctcgtcccttcagggactgctctttctcccagcgttgtgtccaagtttgggagtgtcctgaggagccaagttgcctgagtggggattgtccctttcatccttgagtaatctgatgctatctttgactgtgtctgcctagataatccttccagacaatgttttgctgggtccttctatctactcaggattttacctgaaaacagatgtgttctcttgtattcccaagccctccaacccctctttctgaaacagttctacttccacatggctctacccaaaaatgagtgtaaaagcactcctttctctgaagcatcaaaagcactctgctggccattaattttccatatttcattcatctaattctaattcaccagtcaacattatcgttttcaaatttgtcagaaacccctgctctcttttttgatctttctctcaaatattttgtctgtgtccctaagctttcaacttcccttgaaggtttaggcttttggattggaaagccaaaagatagcaagctttctctgattgctgttctgtagattcttctcctggggcaacaagcacaatagcaaacatctgctttaaaaggaaaagaaaaaggggaaactaccaagagaggaagaaccatattattctgccacttcagcatatggctagacagtaaattaaagttttagagttgggaggaacattagaagtttccaaattcaacctcttttcctatcttctctgttatatgttcctgacagatggtcaaacagattccataatttcagtgacaaataattcagttcctcataagagagtgcattccttcaagaatcattagacttcttagaaagttcattcttatattgagtaagcatctgtttccattatgggtaacagaagctgacgggaataatattggccttggatctaaacagccagagatggttcagatagtctctagaagcttcagtttctttatctacaaaatggagcagatgatacctatctttcaaaattattgggaagattaagtgaaataaatatacataaatacctggtatactgtttgttgtagtagatgtttgctaaacattaaatctgtgcaccttaaaacatccagtaacagtccaaactcattcattcatttattcatacaatattgattgaccatttatcttattccaaatcctggaataaaccctggtagtatagcagagaataaaacaaatttataccttggcgtaaggaaagatagtgtatccagtataaacattgaattactaatgtgagaagttctgtcaagtaaaaattctacttagtataaagagagcacatgcaacaggaaacattaaaaacatctattttcaatctcacacatagacacagacagacagacagacagacacacacacacacacacacacacacacacaaaaccataacgtattctctccccttacagagtctttttatatcaagaataaacactccaaagtctttatctattcttcagatagcatggttatttgatggcttaatgtttcctattacaatgtggaatgttgaaaaatccttttttatgttaactttaaacttaataaagaatttatattattttaagttcttcatgttatttctgtctctttccatgtatacaataacaactgtaagtatgtatattacttttatagtttgcccattctacgtgctaatttttatttgctattatattttcttcttcaatgttgagaaggaaaataagttttaagagaaactacaatttatttccttttggaaacttatttttaaaattcattatatctagattgagtttctaagtttctcctcatcactagacctactgctgttgtgatgcaacaaaaagtgcttgggtatcatcctttataaggagacatctgcactaagtacctatagtctcatgcttactctgtctagctgccctaggctcctgctcacagaacacagcccccagagaccaggtctctccctccttctgcacacttcagtatttaagccatcagtctgattttatctcacattgttcattttcttctggttttaagaagaatttgcacttggagattacttgtacattttgcatttcaggcctggaattgaccccatcagaagctcccaaacaatgaatttgcactctttaccccattaatatacatttaacaaccaaagttgtactgatgtatcaggttttaaaacctcagtagatgatgtgcttgttcccaaaatactctttccctttctttgtaaaataaatctccttggagttcactgtgcctttatgttagaagaacgcattttaaagaatgttcagaaaatcctacttagcccagaattcctatccccttatctgaatttcctcttctttatctctttgaccctggaattcaataaatttgaatattaattttgagattcaatcatcgagtcagatgagtttcccaataaagaaattgacaaagtctcagttggacctgaacgagccctgagaaaaattacatcatatctcagtttcctcagctgtaccaagggaagttcactggcattgggctccttggccaccgcactgaaaataaataaataaataaataaataaataaataaataaataaataaaattgcacatgttaaggaaaggaggtaagagggaaagaagactccttcaccttactgagtgtctttaagttcggctccgttcttgacccaccccacccatctgaattagcttgcttcagaagagccagtgggactgcgcactaatcacagggtgtttcccagggtctcaggcaccagtcccggagtttttcccagcagggctgtgcaccaatcatagcgcctcacccagaaatgccatgcaccatcatgaggtttctcccaaccgggccatgcaccaattacagggcttcttacaacggggccccgtgcccctggaccagtcctgactacacaccttcctcagcagctaccatgccagggccagagggtaacgaggcaggcacttgtccttgaaaaaaggaagaaatatcaccctccctctgtgaatacatgtgattgttctcactgtctcccttgaaagctttattctcggaagtacacgctactatgctacggcagatgtacaatctgggaagttttccaaattcgtcactggaaagcatggagtattcagcattagcgcctccgtggaagtttctgtctctgcctcagtcagtctggctggcagcactgaagagtagacggttgtccagaggctgggtaagtgggagctggaatcctgtgacagaggcactcccagccagcttctcaatttgcagagctgttaaggttttccctgacagctgcacacatgccacatgagcaaaacggtccactgatgaggcaccagcttgagattttctgaataagctaacctctgggaaagtgtaaagtcatgagcttcaccgcgcagtatctacaagggaaggatgcaagagcaattgtcattctcattgcttccagcacaggtggaaggagacactgcggatggtaacttccttaccaatttccattatgtgccctgatactttagatcctgagcagaagccaaggaataaattatgaaaacaacgatttgttcccctaatataatgcaggttcgtatcagggctataatccctgccatctaaaacacgggatcaagttgtccgactctcagaggccattaaaaacattcacgtattttagagtttttcacagtttcaagtacgtagttcagtgtttgtcttatgagaagttcttgaagctaagtagcagctggccttctttatcttgcattacccattatctcctacattgtagaagtgctttcagccctgaagcaggtgttattgtagagaggtgcactgaaagaaagcttggaggatcttaaatgcctgtgctctagaaggtaacccgagaaagaggagagatgcggggacattccaccgtgtctgatcctgacgctgttccaactgtacggcttagacaacaagcagagcgggggatgttgaggctgagcgctagggtggctgccatctgggtggacttgcctgagttaaaggaaatggaggattcttgaatattttcaagtagatttccagttgtctcaagattcaagaatttttaacataactacaatgttgttgctattggtttgtggattttgttttttaatccaagtgagaaaaaaatttggaatatttgagaatgttaaattctaaaatcgttaataaggcctattaagtcctgcatgttctgggttctgtcttcctctgtcacctcatctcaggccactcacctgtacaaaaggaaagaaactactttgttttcattttgtttctaacaagatttatcaaggcaggtttcatggaagtgaggaggtatgagctggcacattgtgtcagttagctatttaatgtggctgcaaaacaagccacattaaaacatagtagcctgaagtatcaataatagccattattattgctcatgaatcgaagagcaagctaataggtcttctggactctctttaaattattcatgtgtccatggccagcttcaggttaggcaggcagctttgctgatctttgagcatttttatgtatttggagatagcactgctgttagctggcctataatgatcttggcttttctcggcataatcttccagcaggccatcctgggctttttgtccagtcatggcaggttccgagagagaaggatctcaaggccacttgaagcctagtcttgagctggcggacttcacatttctcattctgttggccagagaaaatgaagaagccagcccagattcaggagctggagaaatgcactcagcctcttgaaggaaggatcttcaaagttgtattgtaaagggcatagataagggtccatttttataatcaaattaccacaaacttcaaagataagtagaagcacaactggcaaagataatgtgtaaatatgcatccaggtataagaagcaatttgagaaaagcacaacacaggttctataaagggcaaagagaattgctgccagaacaaagattttgtgtgtgcaggcctagaagaacactcaagatttatgagaaagaggactagaaataacacctgggaggaccttccattccacactaaagaatctatgatcagttgaagcaaccaagaattatagcagttctcttgtgcagcattgatcactgatccccatttcttattctggaaactgcccccttctgtgcattcaatgataactactctttctttgtgtacttattatttctctaatgtttattcttcactgttttagttctctgtctccatcctctgttaatttgaggccactcgacattctctgcttagccttttgttgttcaaaaatacctcctcaacaatttcatccacttcattaattttcactaatgtcatttgatggctgtcagatctatagccctcccagattctggagagctgtgatcttgtttatgtaactgcatcctggacatacatctgcagttctaacttaacttgtttcaaagacaatctccttattttgccttctatgctcctcattctcctgtgtattctcctagttaaagaccactgttatccattcaaatacacaagtcaggaagtcaggaaacacctgaacatcctctctttccctcatttcttacattgagtctgcaggtcctgagtcagttatatttcctaatatgttatcagtatctgaatgctctatttatgagctgtggctgtggctcattgggtgcttcaaattgtgtaggaaggacagagataatttgcctcacttaattttaattggaagatggttttactgatgtcttaatgatatcttgatcaagtcatatataagtaaaaaattattttttgaagcattccataatttgcttctaataacctaagattatacacctcattacaagaggcaagtgtgttatcctgaaagactggcaagagcatgcctttcaatgtaacttttgacctttttatgcactagacccagaaatcttgttttcatgtgacttgcagtcatatggcatatagcatttctccatggtcagtgcaaaggcttagcccatctgcatcttggcacgatatgaattgggctcttcctccaagtctgacaacagtacacacaatgaacactgaaatttcataagttctgctcaccaccttaagcaagggttatttaagcagctttctaaaaacaaaatcttatgtggaacctcacacataaagcaaataaaagaagagcttgctttgttaaagtatggataaaagtacccaaactttgcccctggtctccatcccaacctttctaatcacctcctgcaaagcccttggagcactctaactaatcttaaggctctgaaaaatccaactaaaaatatcacgaacctaggggaaacatgagaccaatatactctaggaaaagagcaaatgtcatttatacagaagtacatcatgacttgagctaaatctgatcaatcctagacaacaaaaaagaaaaaagttgcattaatcataaaagattgaattcatatttttattgatatataataattatacatatttttggaggtacaagtgatgttttgatatgtgtataatatgatcaaatcagggtaattggaatatccattacttcacatatttgcttttctttgtattgggaacattccaaatcttctagctattttgagatacacaataaattattgttcactatagtctttctactatactatcaactcctggaatttattccttctatctagtggtgttttggtccccattaaccaaattctcctcattcattctccccactacccttcctagcctctggtaattgcagcactattcacaatagccaagatatggaatcaacttctgtccatcaatggatgaatagacttttaaaaatatgctatatacatacaataggatgtcattcagccacaaaaaaagactgaaatcttatgatttgtagcaacatagatagaactagagatcattgtgttaagtgaaataagccattcatagaagacaaataccacatcttctcagtcatatgtgggagccaaaataatggatcatatcaaagtggattcagaatcttgaccagacaaagaaagagagaggacgtctccctcaattccagtagaacctcctctatgttacaactctagaatgaggctttttctccccaatcttctgtcgttgcttcccttacctggactgccctgatcatatcttacctggattcttgaactaaactacctggttaccctgctgttagttcctgacccatccagcaaatgagtagaacactttccaaagtcatctcactaaaaccaaatattatctcatagctttattatctgtgaaatatggagtaaagttcaaattacacagctttccccagaaaaaaaccacccttgaggagtccctgaccaaactctctggtcaatcctgcctttcttaactcacgtcctaaaccccagtaatcctgggaaaaattagagatcttcaaacttgctacattttatatctccatatctctgtaaatattgttctttctgcttacaattagcttttctctagtgtctacctagtgcaagtgcatctatccctatgcggatttcatattgccttctcctctctgaagacttttctaatcctctcaccttagccttgatccctccttccttgccttatcatggcactttttacatgctcaaaatgtttcaccaatcatactgtattacaattatttcatgacatgtcattgtgccaaacttaattgcaatttctacaggtgaaagggccaagtcttatttactttatcatcacccacacctaacacagtacatgacatcaggcaatggtttagtgacattcaatgaacgaattatggaagcaaagctttaagaaaataaatataggaacagcatggaaagtgaatcagagagaaagccacgtgcatgggatcggttaaacgggtattgagataatcctggctggtgataataataatgaggtaaaaataataatgaggcagaaaattgtcaatgcctatggagcaaggaataatactgggtatctctgaaaacagaatctgcaatacgcagcaagagtttgaaagggcagaaggagtaattgacaataaatccaaaattgaggccagagccaagaatgaatgattttaataacaagccttgggaaagcaggagggaagctgaataactcagttttgggaataataaacatggattctatgctgtgcacaatgctagctattgctgacatgttgcttttttgtactctcctcagttttgaaagcagaactcaggggagagtgaaggctcagaattgtcgactgcgtgacatatgtctaagagcactgagggtagtcatggtcaaggctgtaatctctgccatttgctcttctctcacattggagagcatacaataggaaaattttttaaattaagggagtattttctgcaccttaaaatgaatggtcccaaatgaaggaatttttttaaagaaacacatattttatatgtatgcacacacttatagtgcacttatttctgtatatataaaaacgcaaaaataaatatacaagtttttatatacacaaacatacaatgtttgtattggggaactgagcttttgatttttaatttttaatggcctctgttaattttcactcaatcagatatctaatttgatcactgtattttcgtgtctgaagtatatttttcaagggaatccatgttaacaatactgaactgttctgttaaacttttaaattattgtcagaattttttccttataggtcattcattgtaatggagtaagaatgaatctaaatctggattaaaagattttggtgaattgggagtgttttttccccagactcagaattaatgacttaatgctccctgaagatttcatatctataggcaacatgcaccatcttgctgagttaaaatcctagtaaggattggattaattctccatttctaatgagaagagaataataccaacaatgattctaattatatctcggacttgaagagttcattccttcctaggagctaaaggaaagtctgcatctgttacgtaatttatgcataaagacaaagtcatttgacaaaggttacactgtatgattagaatccaatgtgatagaaattctgcatttttgattctacatttagttctctttgctttaagttcccaattaaaaaaaaaaagaaacaataaattgtaacgtacaaaacgaataattctaatttgatgtgaggaagatatttctgagagacatttgtgagatttgagagtgtggattagaagaagctgtgaaatttttttactagaagtgttctaacataaagcagattcatgtatgtctgatctagtttgtggggatactatctgattgaagcaaggtgaaataaattatttatcaagatttcctgtagtcatagaattcaatgatttctctttgatatgctctgttacattttttcctaataagactcaaaaatacatatataaatgcaaaatgacactgttaaattgcttcctttttgcagggaataaaaggaagagacttgggctgaatcttttcatgcttgcctctctacagtttattttcaaaactgcagcaggcgtaatcctttaaaaacataggtcagaccattgcagcccctaatcaacactctgcatggctccctatttcacctggaggaagagccaagtcttttcaacagccaacagagccctacatgatctacagagctatctcttccccacctccccactacctccctagcctcatcctctgccctactacttgcctactctgttccagccatgctggctgccttgcggtccctctgctgggagcacgcctgcctcagggcctttgcatgtgctgtttcctcagcctgggattctcttccatgagttaaccctatggctttctgcctccctttcttcaagttttttctcaagtgttactttctcaatgagactatcctcattaccccctaattaaaatttcaaacttcgtccacctccactgaattcttttttttacataatatttgttactttctcacattcttcataacttgcttacttatgtttgtttttgttgtttctcccctccccccaacatctagaatctcccaacttctagaacatatgctcttgatgggcaagggtctttgtctattttagttgatgtttgttgattaatttcaaaatggtgtctgtcacatattaggttcttcatatgttttgtacaaatgaactaatactcattaactaagatgagcaatgattacaagtgactagtaggtagcttttattttgcaaaagatgtaatttctatataagcatattttagtcagaggagtaaaaagttgccattcctgaaaaattactcaaagatatactctagcaaattgaaagacaactgaaaataagatgaaaaggcaaagtataaaataattaaggctgaatatcaataccaataaaatatagaacgaaatcttgttcattttgttaacctttttaaatataatacacatttcaaaaacaattattgaaagagaaaacataatgtaataaaataatgtaatcataaagtggatctaaaagtaacagattaaatcagtacaaactgggaaatagaaaaaaaagatataagggacaaagtaaaaatggggagaataagttcccactatttacaaacagcatcaatggaataagcattattttagagtaatgatgccatgagaagaaaatgttcaagtacttttcttaaacctgacttccacataacagaccttcaaatccttgaagacagttgtcatgtcccacccagtgcttagtatgtgtgaagcatgatagactttgaactgtcccacatagaacagaagttcaagttcttctctcatctgagtcccctactcaagctcctcctgcagattggatgccagaattggacaaaaacttcagctgtggtccctgcaacacaaaggagagcacacacaccctctcacttgctctagatattttgcttttatgagtcaccttaagatcatgtttttgaggctatgttaatgactctcatggagttcttaccaaatttaattcctcagaattacgctacatatactctactgtgtacaaccaagtgtaggacctcattcttttccaactaaataacaatttgatagattttagctcgtggctatatcatgtcagtgcaattttgattcagcatattcatgaatcataaagttaatttcaactacaaatttgggagagtatgttatttctttatttaagaaatataagttattgggaaaatgctgaaaaagataatggaaaggacggaaccacgcaacaatccactagaaacctcccttgtgattgacatcaatgcactaataagcactattgaggtagcgattgagctacttaactgttttcgaatttcatatttttctatattaagaataagaacaatttaagattttcccaatttaagaatgagtcctggacaattatttctttaggttcttcatctgctaaccctatcatagaaataaattcggatatgctgttgtcattagaaacacgctggctttcttgtgacctttctcgggatatttacacattatcgcttaataatttattctaaaatctctttcaagattcatatcaatagtttgcataatttttcttcctactttttgaaaactaggaaattaatttgatatagctacacaaaagctgttcaaaaaaggtcaaacaagttcaaggaaattagtatgatatgctgcattattataaagcacactgctagatttctctgtaattatacttttaattctaaatcaattactttgagaatctatattaaactttgaatgatgaccaattaaaaacgtctttaaatggcattgcccttcaaaatggaatcagtgctaatgaaataaactgcttttgatattgtgaaaatctgattacatgattgcttctgtagctaattggacaaacttgcatattgaatgcttctaaatatctgcttctcttccacctacttttctatcatttggcagtgatgaggagggagaaaagaagaggtctcttagttgaacttaagatcttcaaaagcctttccatggtttattcatgcttgtcctatcctttggtgttgttataggaagatatttaaacttgcttgggtgttattaacattcctggagttatgattagtcttgaactgtagcctgtagtggaattccacagaagggtaaagtcatagtatcttatgttattcaaacttatctactatgcagaatgaaaaaataagtaaccaatgaattattacttagaatctgctgttttaagaacaagaatgttaaagaaaatttgtacatttaattgcttgggaggtcaaggcaggaggatcacttgagttcaagaccagcctgggcaatgtagtaagactcaatctctaaaaaatttctttttaaaatctagctggatgtggtagcacatgcctgtagtcccagctactgggtaagctaaagtaggcactagagcccaggatttcaaggctgcagtgaactatgattgcaccactgtactccagtctgggcaatagagcaagaccctgtctcgaaaaaaaaattagttgcttgatggtgattttaaaattcagaatgactttaggtagtttaggttatgtctctatgatgtaaaaatggtcaacttagaaaaatgtaaagagtaggaagaaatctctcagacaattttggaggttcaaatgtacttgacaattcagagaagttacacagggtaaaataaagaggcaaagaacctgaagaccacgcagattccacatcttgtgcttaaacactggtgctttcggtcaggttgttacaactccctgaattgcaatttccttagctaaaaaatggagaaataatattttccagaattgcctcaggataatttcattcaaatgtggaagtgtcttatgaactatgaaatgcactgcagactcccagaaatataatctctttttccattcatcccctaattcaataagtatggtcaatttggcagacatgtattatttaaaccttgaatcacctattaatcatcacctttggcaaagaaaatggagatgcaaaagtaggttctgtataaaaagcttaaatacatgatttgcagcgaagctgtatttactcagttaaaaaaagaaatttatcttagaagccagttttaaaatgataattaactgttttgtgttgtctagttaactgattcttcaacaaacatagtttgaagaagttagaccttttgttttatgcaaaataaattatcatcagaccatattttctaagctgaaaaatattgtatttttatactattgtcttccatccatttagtttatgtaccttaactgcttcatggtgctcttggccagaaacaaattatttctaaatattatgtttgcattttgatcctttatcttaactgtaaaattatacatagctagtcttttctcttataaacccatctgtggttgctgaaaagtaaattattttgttgaaggtcagcattaaatccagccagatttaccttttattaatccctgtttgttgcttagggattttatcactgtgctagaaccactttttggccccagaatcttttctctcaatttaattcataatgccactataatgcaatagatgttaggatttggccatctgggcattttaaaacatggcagcagaccagtggagtctcagtttggtgttgcatctgatgttccctccttactacacatgaccagccatttttcaaaaatgcagagcctgtgtccaacagtttactgtggccacatgagctttagtcacgctttgtaactctcaattagaaaaatctcaaatttagtcattacaagttttatgggttgtgagagcacaaggggtccttaaaatgaccagacagctgaaagacgtggcaggcagtgaaacatcaagcaaggaagtatcctcgcaggccagtgactaacgatccctcctgcgctcagtttatgttgaaattaaagtaaaatcctattttcagtattgagtaaatggggtcgctagaatgctatgcaacagaattatatgtggaaaaaaatgatgtgacgtatacaattacctcagctattcaaattagctcttttcagaagtggtctctggaaccctgtttccatcatttggcaatgagccagagggaaaaacaaatatttcccaggcttctctcccaaccgaggagctgcacattcttcaaaatctcagatttcacctcttatttgaagcctgtcttgcatggccatttggaactgacatttctgctgcaattccaaagcgcgaactccgggggctgaagtccacctacgctccacttaaccccatatactcagaatgcgcagtgcggcatctgtccactgggggcgtctttttcctcgaattgcgctagggctccccagcggctaacagtagccacctgcgcttgtgttcgcgttatgtatcgtttccatccttcgtggcttgatttagttctttatactctcgtcctcatatctggattatagatcgttcccacagtgtcttcacacttgacctgcaaccaaaggatgctcaaagtcgggtaaatatatagtatctaataaatttctgtaattctcaattcttctacagtggcatatgctcattcgaagaatttgagtatgtcattctcaatttgagtatgtcatgtgtattatatttgacataaatatacaacttctaaaccaatattttttgtatcattccactcagaaagtatccagtttaagacaggagaatacacaattataatgtttaaaaaactgggatggggtcaaaggcattggaaaaatattttaatatggagattacggacgttacagaagcatatgtttggttattacaatcttgaaagttagatttttatgcacatattatagaaagacaaaatttctgtggaaaatttgtttcctgatcaaattaataattattgtacttgtattaccaagggtaaataccaatgactaaagtaaacatcgtttatgtggttttctagatggtttcaaatttgaaatttagaggctggagactagcactacattttaaccactcttgtaaattatgtcaccaacatgctatccttattcacagatctatttttgaaaaattctagatggcttgattttaattttatctcaaatagttctgttgttgtagaacctacttagaaacatttaaggtttagtttccagaactttgttctaggaaactttgtttggtttcacttggattcctagattaaatttaagattccttctgtagaaatattatgaccacatatacaacatgtcaatgtaaatgtcaatgaagccatataataatagaaggattaaaaataaaacccacagggaattatgctgcactgaatcaaattgtcagcattaatgatcgcctccgtttacacccatatgtcattcctttcattctgtagcatcgtgggaatgagcactattagagtaatatattccaaaatagctcattatgggtgggggttgggaaagagaaatattatttcatatcattactaataaatttaattacctgtaccctgctagcagtacatacattcattactttaatatattaaaaatatattacctaaagccacagttaactaagtaatagcactgcttaatcttatgatattcactgtttttggtcatctttcactagatattctctgaagcaaattctcatttttgttttaacaatattattatctaatttagatttttaagatcaacagaacattttagcaagataattattaaagctaggcttctacatattttcctgtatgtaccattaaattattccccaactccccacaaattgcctaaaaaaaactcaaaacatttagatatatcagctatttaaccaattttattccaatttaattactaattacttagaaattaattgccagtttcatttcttgagaactccctcctaaaatcttttgcggtaatgcaatctggatttgttaagctatgtgcccagctctcattcagaaatctccctgcggaaacatcctggggatttcctgtctccctcttgcttggttttctctctcatttagtggcgcacatcttggtgtgcacaggaagtacatttgttgagacttttatgtttaatgtatttttatttaagctacacacttgatctattatttgtctaggtgtaaaatgctgggcataacatcattttttcattatattctttctatattctttagcacccagtatcactggtaagaaagtcaaagccaatttatatcctaatcttttgtttatgactgttaccctaccctgaagcttgtagcatttgctctctgttcatatactctaaaatttctggatgacttgattggatattggtccattttcatccactgtgctggttactccatagactctttcaatatgtcaacttacgataattgatttgagaaatggtctcaaaatattttattgctcattcagttcccttcctctgttccaggaacatccatatttggttacccatcttccctggttgaatgtttaattttcttatcttttctttcttattttcatcttttaaaataatgtatcttctagaagattttttaactgtattttctaaactttctaaatgagattttagtttacattacaatatgtttcatacctaaaagatcatttttttctgcctaaattttccctttttatagtattttaatcctcctccatagttataatattttatcttggctttctgcagatatgaacaatagtccttttttctagagaaggagagctatcttcatcattagggtgtctgtttctttcaagtactttgtatgtttcttcctgtttgttgtggtctctgttccccatttttgtggctttactcaaacgtctaacaattcttagttgtaggctcatatgtaaaagttgggataagaattgctcaaaagctcttaatacgtgctgtgagtcttattgccagtctccttcatagtaagatgacagatttggcttgactctccagctggtcagatatcccaaagagagccttctagatttccacctggaacaaaagccaggattcctccttgcaagcttataaacttttcttaaaactcttatttacatttcaatgacatttgaggaaagaaccagagcatatttgtccaaccaccatcttggccaagaattcccttttctttcttgatagtgttggcgctagagcataacttgcaaaattatgtaataactaaataattgttgagtgaataaatgattaatagaaggaatctaagaagttaaaaaggattatccttactacttatttgtgttttctttaggaggggttttactttaaatccaatgccaaagtgtctgaaagtccttaagaacttattgaatggctcatttgttgctgagaacaatgatttggttaaatggaatgaaaggctttaagaatctcccatttttttactggcaatacctggcacaactcagaaccataaaacatcttttttataaaagttgatagtactgaaggtacgtcatatttgatatggatatgaatgttctaaaaagttgcataaatatgagattatgaacaatttctctttcactttatactactttatcatttttcaactaaattatcgctaagaatttcagagtttagtctttcatattttgaggaactgagagagtttaatgaggagaagaccaactgaacagagaccctgaattatagtttgattcgagggattatgagagccctttagagacaacattggacctagcaattggcgcagtccggggaagcggggctctttacaggcaagacatctcatgctggacatttagccagtcctctctggaaattcatgactttttttggaaacttttcttcaattatttgttgataatcttttcccttccatattttgtgtcctttgcctttcgatgggaatttatgtcacttaaatattgggtattctggactgttcttctatttcttgacttttctactttctatttgttaatttttttactctactttcagagaggtttcttaaaattttgtcttctaatctttctattgaatttttcgcttgtgcacttatgtttctgatattgaatatattttgttgttgtttgagttttctgcattaaagcaacctgttcatggtttctgcatgttacaaatagctttgttttgatttttctccctgcatagtgtttcctccaagttgctttagatattttgttgtttgtttgttttgatctttatggcaggagcctttccacaggtttttctcatctttgactttctatgcattcctgtaagtaagggatttaaagcctgattgctcctgataaacacatgatgggacttctccactctgagctacattgtaagttgacctgtgtgagtattttattggggaatcccaatagtttttgtctttatcttttctgctgtagagtggatcaaattacccaggaaagacttctaatttctatctacaggaaggggtctagaagccagctccaagtagaagaaagagctgggggtgtttgcattcagtattcagtatgcatctgatgatgaatccccatgttgtcagtatggtacatacacacaactgtgtgtagcattccccagctgaagatcttattttccctttctagtgaatacatctccagatttttaggggaggagggacatgcagcagtgaaacatcagatatatatttggttctcagacatattctacctaagctgccagagttcagaaccactcccttcgtcttccttctaaaagtaatggatactttcaatgattctgcaagtgtaaattgggtttgtccctacccttccctactgatggcagtttccattcattcgtttatagtttccgaaactgtgccctttactgctcctgatttccccatccttgtggtttatatttttaagaatatacacccctttgctatcatttttgtaagtatgtcccagtaatctatcttaatgaaagactaaaatggcatatttttaatatttacttatttattatttttatttttccataagttattgggatacaggtggtatttggttatatgagtaagttctttagtggtgatttgtgagattttagtgcactcgtcacccaagcagtatacacttcaccatatttgtagtctttcatcccttgctcccctcccactcttcctcccaagtccccaaagttcattgtatcattcatatgcctttgcatcctcatagcttagctcccacatatcagtgagaacgtacgacatttgagtgtccattcctgagttacttcacttagaataatagtctccaatctcatccaggtcactgcaaatgctgttaattcatccctttttatggctgcatagtattccatcatacatacatacacacacacacacacacacacacacacacgcacatatatataaaacacagtctccttatccactcattgattgatgagcattttggttggatccacaattttgcaattgtgaattgtgctgctataaataggtgtgtgcaagtatctttttcaaataatgacttgttttcctctgtgtacatacccagtagtgggattgttgaataaaatggtagttctacttttagttatttaaggaatctccacactgttttccatagaggctgtactagtttactttcccaccatcagtgtagcagtgtttcctgttcgccacactcacaccaacatctactgttttttgattttttgattatggccattcttgcaggagtaaggtagtatcatattgtggttttgatttgcatttcctgatcattagtgatgttgagcattttttcatatgtttgttggccacttgtatatcttttgagaattgtctatccatgtccttagcccactttttgatgggattctttgtttttttcttactgatttgtttgagttcattgtagattctggatgttggtcctttctcagatgtatagattgtgaagattttctcccactctttgggttttctattaactctgccgactgttccttttgctatgcaaaagatctttagtttaattaagtcccagctatttatctttgtttttgatgcatttgcttttgggtcctccatcatgaaatcctcgccaaagccaatgtctagaaagattcttccagtgttatctcctagaatttttatagtttcaggtcttaggtttaagtccctaatccagcttgagttgatttttgtataagctgagaaatgaggattcagatttatttgcctatatgtggctagccagttaccgagcaccatttgttgaaaagggtgtcctttccccacttcatgtttttgtttgttttgtcaaagaccagttggctgtacatatttgggtttatttatgggttctctattctgttccattggtctatgtgcctatttttatactggtaccatactgttttggtaactatggccttacagtatagtttgaaatcaggtagtgtgatgcctccagatttgttctttttgcttagtcttgctttggctatgcgggctcttttttgataccatatgaagtttagaactgttttatctaattctgtgaggaatgatgtggtattttgatgggaattgcattgaatttgtatattgcttttgtcagtatggccactttcacagcattgattctacccttccatgagcatgggatgtgtttccatttgtttatgttgtctatgatttctttcagcagtgttttgtaattttcttcatagaagtccatcaaccccttagttaggtatattcctaattattttattttttgcagctattgtaaaagggttgacttcttgatttgagtctccagttggtcactattgatgtatagaagagctactgatttgtgtacatgaatcttgtatccggaaactatgctgaattcttttatcagttctaggagcttgctggaggagtccttagggttttcaaggtaaatgatcatatcctcagcaaacaatgacagtttgacttcctctttaccaatttggatgccttttatttctttctcttctctgattgctctggctaggacttccagtactatgttgaagaggagtggtgagagtggacatccttgtcttgttccagttcccagagggaatgctttcaactttttcccattcagtattatgttggctgtgggtttgccatagatggcttttattacattaaggtatgtcccttgtatgcagattttgatgagagttataatcataaagggatgctggattatgtcaaatgcttcttctgcatctattgagatgatcgtttgatttttatttttaattctgtttacatggtgtatcctgtttgtcaacttgcatgtgttaaaccatccctgcatccctggtgtgaaacccacttgatcatggtggattatctttttgatatattgttggattcagttagctagtattttattaaggattttagcatcatgttcatcaaggatatcaatctgtagttttcttttctggctatgtcctttcctagattcagtataagggtgatgctggcttcatagaatgaattaggcaggattccttcttcctccatcttgtggaatagtgtcgaaaggattggtccaattcttctttgaatggctggtataattcagctgtgaatccatctggtcctggactttcctttgctggtaatttttaaattaccatttcaatctcgctacttgttatttgtctcttcagggtatccaattcttcctgatttaagctagaagggttgtatttttccaggaatttatccatctcgtctacgttttctagtttatgtgtgtaaaggtgttcatagtagccttgaattaccttttgtatttcagtggtgtcagttgtaatatccaccgttttgtttcttagtgaggttatttggattttctctcttcttttcttggtttatcttgttaatggtctctcaattttatttatcctttcaaagaaccaacattttgtttcatttatcttttgtatttattttttgtttcaatttcatttagttctgctctgatctttgttatttcctttcttctgctgggtttggatttggtttgctcttgtttctctagttccttgatttgtgaccttggaacgttagtttttgctctttcattctttttgatgtaggcatttagggctatgaactttcctcttagcaccgcctttgctgtattccagagtttttgataggttgtgtcattgttgttgttcagttggaagaatttttacatttctatcttgattttatttttgacccaaagctcattcaggatcagattactaaatttccatgtatttgcattgttttgaaggttccttttagagttgatttccagtttcattccactgtggtctgagagagtgcttgttataatttccattttcttaaatttactgaagctcgttttatggcctatgatatggtctgtcttggagattgttccatgtgctgttgaatggaatgtgtattctgtggttgttggatggaatcttctgtatatatctgttaagtccatttgttccaaggtgtagtttaaatcattatttctttgttgactttctgtcttgatgacctgtctagtgctgtcatggagtatgggaatcctccactattatttgttgctgtctatctcatttcttaggtctattagtaattgttttacaaatttgggaactccagtgttaggtgcatatatgtttagggttttgatattttcctgttggacaaggcctttcaccattatataatgtccctctttttctctcttaaccactattgctttaaagtttgttttacctaatataagaatagctacccctgctcacttttagtgtccatttgcatgaaatgcctttttctacccctttattttaagttcatgtgagtccttatgtgttacttgagtctccctaaggcaccaaatggttggtgagttcttatccattctgtggttctgtatcttttaagtggagcatttaggacatttacattcaatgttagtattaaagtatgaggtattgttgtattcatcatgctcttcattgcctgtgtactttgtttctttttcttttttgtttttgtttttaacttgtatttttgtttgataggtcctgtgtgatttatgctttaaagaggttctgttttgatgtgtttcctagattggtttcaagatttgttcctttcagcagttcttgtagtggtggcttggtaatggtaaattctttcagcatttgtttgtttgaaaagactgtatctttccttcatataggatgcttagttttgctggataaaaaattcttggctgataattgttttgtttgagaaggctgaagataggcccccaacctcttctagcttgtagggttcctaccgagaaatctgcagttaatctgacaggttttcctttataggttacctggtacttctgtctcacagctgtaaagattctttctttcatctcaactttggataacctgatgacaatgtgctaggcaaagatctttttgcaatgaatttcccagttgttctttgtgcttcttgtatttggatgtctaggtctctagaaaggctggggaggttttcctcgattattcccccaaatatgttttccacggttttagaattctctttttcctcaggaacaccgattattcttaggtttggtcatttaacataatcccagacttcttggaggctttgtttgtatattcttatttttctttctttgtctttgttggattgggttaattggaagaccttgtctttgagctctgaatttctttcttctatttgttcagttctattgctaagactttccagagcattttgcaattctaaaagtgcatccaaagtttcctgaattgtttattgtttttttctttaagctatctatttctttgaatatttctcccttcacttcttgtaacattttttggatttccttgcattggacttcacctttctctggtccctccctgattagcttaataactaacctcctgaattctttttcaggtaaatcatgcatttcttcttggtttggatccattgctggtgaactagtgtgattttttgggagcgttaaatagccttgtttttcatattaccagggttggttttctggtctcttccatttgggtagcctctgtaagagggaatgtctagggctgaaggctgttgttcagattattttgtcccacggggtgttcccttgatgaagtactcttccccttttcctatggatgtggcttcctgtgagctgaaatgcagtgattgttgtctctcttctgggcctagctacccagtaagtctacccagctctgggctggtactgggggttgtctgcacaaagtcctgtgatgtgaaccatctatgggtttctcagccatggataccagtgcttgttctggtagaggtggtgggaggttcagtggactctgtgagggttcttagttttggtggtttaatgctctatttttgtgcggttggcctcctgcgaggaggtggcactttccagagaatatcagctatggtagtatgggtaggaactggcagtgggcagggccctagaactcccaagattatatgccctttgtcttctgctaccagggtgggtagggaaggaccatcaggtgggggttggggtaggtgtgtctgagttcagactgtccttgggcaggtcttgctgtggctgctgtggaggatgggggtaagattcacaggtcactgaagttgtgtacctaggaggattatggctgcctctgctgagtcatgcaggttatcagggaagtgggggaaagccagcaatcacaggcctcacccagctcccacacaaaccaaagagctggtctcactcccagcgtgcaccaccctgccaacagccctgagtgtgtttccaggcagagggcttgaaaacttgccccagactacccgcctctcagccttgaaagaaaagggcttggttcttccctgtgaagtctgcacactgggtttgtgccctcccctgagttctggccaggaggtttctcaccccattcaaattattacaaagctcaactagagatttccttctccctgtgggattttactccctgcttccctggccactctcctgacagatccctgtggtgccaggcaggaatggcctgctagggaacccagccagttcccagggcctttctgctgctccctctaccactgtatttcacttggctctctaaactgactcggctccaagtaaagtcggaaacttctcccacaaacagaacctcagcttctccagtgggagtgtgtgttcggtagaggagagtttccctttcctgtctccagagtgggggcactcacagtatttggggtgtctcctgggtcatgcaggagcagtctgcttccttcagagggtctatgggtccttttgggattgcttgcacctgaggtctgagtaaggagcagggagaccttgggtagtgcagggctgccaccagggtgcacacacacttggggtccgctgtcagcttcttggtttttatttttgactctcatagcatatgacaaaagcttgcacgtagtagacacttacctggtatttgtaggattgaataaatgaatattttaaacacatccaaaacgtagaactacagcatttgcacatgctacagatttatgcctttaacaaattaatgaaattaaatgtctctttcctcctccagtaatgcaacatatagataacttcatcagtttaaaaaatctatattgcaaaaagttaacaataatttgagtgagcattttatctatccctgtgttcttatctatccaacaaacacttattgagcaacaacaatgtcactaataaacaccaagattaatgtttgcgttttgttatacaacatgtctattataaactggacatcattcaattagtaaaaaagtcccttcaataaatttttatatattgagacttgttatttctcaaatcaagaacagattgaagtaaacatttctatggtttatgtgtcactaaatagaactttgatatatagactctcacattctattactaaatttaataatgcaaatggagttttagtttattgcttctgtataaatttcattaggtttctgaggaagctgtaaagctaattgtaatgtatttggaatttggttagaaacaggttgcttttattaatagttttttcaaccagaattatataaaaccactagattgtgatagatcagattcaatttatccagatagtataatatttccttaaggatgtaacattagagatgtaacataatttttgtattggatgtttcatcgataaaagtttatggatcagcaggcaatataatttgccatacctctccatttttcatttcagaaataaatcattgcttgtacaagagtatgacttttttatgttacagtttcacagactgtaattggttctgatttatcttaaaaagtgtaagatttatattcagataggtttattgaagtgtaaatctttaaaggatgacagcattatttttaatgtatatgatatttttaaaaagtaaaataacatactagggtacctaactcaaaaatagaggggacttcattgaaataaaaaagaaaaaaaaatacaggagactgcttttcttagctataaatctttgtatttatttgatcttttatatcatatgtatgttatttattaaaattaaaaattaataggaaataaagtagctaatacctattgagcactttctaaaagccagaaaatctgctaaacactttatatgggttgtcccatttaatcctcaaaatagccctatacattattgttcttcacattttatagattagaaaaataccaaggcttaatataaaaaataaaagaataagatagtcatgttaacaatagttaatatttaatgaatacaagctatgtttagggcactgttctaagtgtttcatgtgtattatactatttgagcctcactacaagtatgaaataggtgcaatttttctttttttacaaatgatccaaaaatcacagggccaaaattcaaacacaagcacctgcattcacagcttgtgctaaaatacgatgcttggatcacttgcaaaactttatgctacaagtatgagaaactctgacacaaaatgcctccaacattaaggtcattaacagtgctgtttgtttagttaattcttgcactgctataaagacctgagactgtgtaatttttaaagaaaagaggttgaattagctcacagttctgcaggctgtacagatagcatgggtggggaggcctcaggagactttcaatcatggtgaaaggtaatggggaagcaggtacattatcaaatggcagcagaggagagagagagaagtaggaggtgctatacacttttaaacaaccaaatctcaggagaacttactatcacaagaacagcaagagggaagtccacccccatgatccagtaacctcccatgaagaccctcctccaacattggagattacagttcaatatgagatttgggtggggacataaatcgaaaccatatcaagggcacatcacaaagtccagaagtagagccagtgtccaggttgactaatgtgataatgtcataaaaaacctaggttcttcccatgtctctgtttagcttctctgctccttgtgggctttcaattaaagcaagctatttaaacttattgaccctaaatatattcaaatgtaactgagaatgacagcctttcagtgttggtgcaagactggaaacaggaagactgcatcatttccaagggttcatatctcagtacctcagtttcctcatctgcaaggtcaacataatgatattatctatgctgtcggtgttgtgaggattaagttgagatacataaagtgctaacaactgtgtctgtcacactgtaagtgctacagatacatttgttgttgtcattgttacgttattgtgacaatgtcaagaagaaattatggcactgccttagatgtggatttaattaaattgctgcctggtgggagttggatttcaagccaattcctgaagaagtcacctaatgggataataggtttacccttagaccaacagctgggacactctggagctgagggtagagtcaccttttctgaggcacaaggccatgcagggatggggcataaaaggagcagggtggcaacaacctttcctgtctgctatgaagatgacataaaggcacttagcacaggggtgtttagagaacagggagcaaggcagcattcttggagcaagtttgccttccatccctgccatggaactgctatttgcttgaaacacttattcctcatttaaaaaatggaacatcactcaaggttgttttgactgaatgagtgtagatcctgttcctccttttctacttccatggtgtccctcctgtagctgcacagtcaatgaacctcccaataagaagacacccctttccacagcccttttttgtcaatgatacacaagacaccatgctttcctgccaggccctacaaacaagtgaaaatgataatacgtgtcatcccgactttagagaatggttttaagaatcaaatatgataatatatgtgaataaatgttctttaaacctgtaagactgtatatagcagtgaaggataggggttaatttacacctacaagatttctgatctatctgctagggtgcttcattagccttttctgataatggattcatgacagttgtacattagaagctatgtggatcactaacccatgacactgacatcttagttataaaagtgagcaattttatagaacacatattagcgagaacattaacaaaatgatcagaatttgatgtttcctaatgggccattatatcctttttgttctttatttttaaagtaggttaaaaaatacatgaatctgtggcagagagattaatatcattctaaagagctggcatcagaacattaatagatatacagagtttctccctttgacctggaaactggaattctgagaagaaaaaaaaaaacaaacaaaacaaaacttagagaataacagctgtcaggaattacctctcaagaaatccaaactgccagccatggtagctcacatctataatcccagcacttatgagatgaggtgggaggatcacttgaggccaggagttcaagactaacctgggcaacatagcaagaccctgtatcttttaaaaaaataaaacccaaccaaaatttacctaaacattaacatttgttactgaagatgtgcctgatatcctaaattaccaaagcagctacatcaatgactgaattatcatagtttcaattctaccttaaaaattactatgtgaaagggctttcgatcaagaagtagcatgaatgttatagcaaacaagggcttgactagagctgaaaagagtttcatacccagaatgtagagtgtgaagaggtcacaattcagtaagtaatcatgtggcttctattgctgagtagtcacagttatttatagaaagaatattcattttctatttaaagtattctttaatattttggaactacttcacttattttcctacaagtatcaggatattaactataacatattaagcttctcaaatttggaaggtgactttttttatgtctgcctatgctttatgtgttgctttcatcaattagtgacgtctgcctataagactggtattgtaacacaggagactttgaataaaaccaaagttgtgtggcttattgtgttttatatgctttattgtaattaagggtttttttttttacagtagcaagtaatgaataatcattatccagctaatttgatcaagtgctaattttgaattctaaattggtcaaattaatgtttaaaagtgttcagtattaatatatgcacatattgagattcttattaaacaagtatttagttttattatttgttatgtatgtctgtttcagtatgactatagaaaataaaccttatgaatagatttttgaatctttttaatttactagacaatagttcccaaaaaatctttgtgatggtgaatcagatggcaaaaatgataggtgtaagaacaaagtatatggctttttgagaacatgactgcctttaggttatttcttagcgtccttaaccataggtaaatcacttggttagtatggtgtatcagtccattctcacactgctgataaagacacacttgagactgggcaattcacaaaagaaagaggtttaattggacttacagttccatgtggctagggaaattctcacaatcatggtggagggtgaaaggcacttcttacatggtggtggcaagagagaatgaggaagaaaaagtggaaacccctaataaacctgtcagatctcatgagacttattcaccatcacgagaatagcatgagaaagacaagcccccatgattcaattacctcccactgggtccctcccacaacacgtgggaattctgggagatacaattcaagttgagatttgggtgggggcacagccaaaccatatcatatggcatactacttgtaaaacaaccttatcaataaaggctgagataaacagaaggattatttattatataactgtgaagttaactgtacatatttaatagtatgtaattccccagtactttgtttccagaatcacatctaagggacaccaggttaactgactaaattccaagacagtcaaatcattatttgttgatgattttttaaaatacatttcaattcaccttgctaattcatgtatcttttttccttaatttattaaactaatttatctgtgtaagcacagtattatttataggaatattgttctttttaacacatcatttaaaatattcaattgtggtaaaaccattttttcaaagtagcttagcagaacacagacaaggaggcaaccaattcttgattccaatgtcaagtctcattggctgtcatctagagcaaatttatatctatttttaaccattttctttgctatattcctttacttttttttttataatgtacttcctcactctaagatattcattttggttttctctaattcttttatagtttacattttatgtttaactctttaatatatgtggaattgatcattttattttaaagtatacatgttgttttatttaagaccaaataattcattcaataaatatttattacctgctcattatatatctgaccctgtggtaggcatcgcacataaatagatgatttcatgctagctcttgagagatgtaaaatcagcgggcaacacaggctacgaaaagataaattacactacagtgtggaaaggtccaaagagtaataaggagacatattgttgtgccaatggtggtttctccattgattagggttctgtttcttggtgcactgggatgctgagttcatagtaaactctctttacaaagcagggctcacattagtggataaaagcaggtgtgcggttgactatggcctggctcaggactgctgaccaaagcttaacaagaacaatagacaaatgtcactggggaagcactgttgctgccactctcatctcataagtccaaaaagagtagagtattgtgattatttcccagggagatattaggcatagaatggtcctcataatttttgtgacccattacttcattaaaaatctgggaaccataagaaactaatctaccaaaaatggatgcttttcttgatgctaaatttgtgttgaccagaaccctggttatattctcttgggaactagcctcaacattttaacccaccataaaaagctttgaaaagttctgacatgatctagtcctataaatcattgtcctgtaattagctgagattttgtttggctttttcctctgagcatatggctttgttctgaattgattttcagcaaataatcaatttgtcttatactatgcctgacaggtaagtcataactatcaccaacactaatgccataagttggttaacatttcctgtaatcttctgcatacatttatacatttctttctttttttttttttttttttttgagacggagtcttgctctgacatccaggctggagtgcagcggcgcgatctcggttcactgcaagctccgcctcccaggttcacgccattctcctgcctcagcctcccgagtagctgggactacaggctctcgctaccacgcctggctaatttttttgtattttcagtagagacgaggtttcaccgtgttagacaggatggtcttgaactcctggccttgtgatccgcccgcctccgcctgccaaagtgctggaattacaggcgtgagccactgcgccgggccgatatttctatcagatgcaagaattatcacaattcagatatagacactaaacaaaagccttcattttatgtaggattgtgtcaaaatgaagtatttataaaaataagaagctataattcatacatcccaagttagaacattttttaatattgagaataattacataaatagtccagaatgccttcagtaataattcctgatattttatgatgattaccttaacacatttatacatttacattaaattacagaaacatattcatttctaaatgttaataaataaatatgcattgtgtgtggtacattctattacaactctctgaatttcagagcagaattcatggtcatgagtaaaataaatgcccaaacaataccatgaattattaaatatctgtcaaaattcccaatggaattatgatttcataatttgaattctgttttttgttaattgtttataatgcatggatccgacccatggattccaggtttattgaatgttataaaattctcttttctcctgtgcccaggcagtcagtctttctgactaagctaacaatggcaatatttattccctttttcctccttgaaaacttttttctatagcatattctccaaaggcaatgatgactgactcaagccatcaagttatatggcctcttactgcaaattgtttccatttgttggagggctccagaagaagctactattttgatcctgaacaaaggagaggagttgagaataagagggaaattgttcttcaagttaacttgcacattaacttgttcatagaagaggtggctgatatgttttcagcaccctttcacttaactgtactttggagtttttgcaattacagtccagacttacttgaactacatgtggtcgatattatgcatctgccgcatcgcttacttcatgcgtctttatagagagccacgtaagagcatatactgacctctgagatggtgtgaaacagtggagaggcaatagctaggaaaatctttgcccttataaaatttatgtcacacatgctactctattcattactttttacgtagccccatctgtccaggagtaaaatatccctgtagcagagtcacatatagaagccggaaatttaaaatatgactttccccaaatagagccaaatataccagagagcataatattttgctgaagactgcctcaattctaaaatataagaaaactatgagagttttaaattgaaatttttgtaacttgcctaaggtattatcatactgctactttgtgcttggcctgaaattagagaatgttaagcaggtaagtgaaaattaaactcctcaaggatatataaagagtgcaaattctactatttcaattctcctttgattcaagtttaaaattcaggcaacagcttcctaggcaaactgagatgctttttttcctcttaacgatgagactatgattagaacaccagccaaactgtgcttcttaagtctcactcactgggtctgtggtacaactgctggctttgtgcactataagtccttcttcagccaagtgttgccttagagtagagaacaatgactgtaaattgcctttgtattgtagatatgaacaagaaaaaaatatgcattcattcttagagatcttgataacctagtgagatttttcaatttataatgatctctatgtgggaagattattacattcataaggaggaaacctacatcatttgaagactccttgtgtgttatttaaaggtgaaatagggcagaacatagacaatggttgtggcctcaactgttgtcacttcagacaccttgaaacatgtagccataataatctactcatcgtctcttgaatattccacctggcaagtgtccctgtggatataatcctaacttatgatagaagagttgtttcatggctagagacaggtctgtgaaagggaagagcttttccactttggataagaatatttgtattcatctaggtgtttatggaaagcatagctaagtctaattttggggagaaaagaggatgttttaagattagccactatcagtaaggagaacaaccagaaattgaccagtgcctcatagaagaaatggtctccccatgatctgaaaatttaaaagaatgtaaatattgtttggaaaatttcaaattcaactttaattaaagaaaagctaaaagtgccttgcttcatttaaggaaattcaagttgttgagattaatctttgccagtaacaataaaatcattcattttctaatgaattaagtagtggcttggaagccctctgggctccttaaaacactacgaaagatacctccatgatgcagccatgaatttaaaaattttgaagaatgaaataaccctcattatcattcctcccaacaaattaaataggaatactacaaaatgatgttcatgatttagataagtcctttgtggccattggcccttatacactcatgaactatctggttagtaataattttgtttaggtgagaggcatacagctaatgttggcatgaagaatctgcaagattggtatgattacttaccgtcaaatcaaggagtccatggagacgtgaagagagacaatattcttaaaataaatgtagctacagtgggcagatgtgggagtttcatctcagttcatcccatcccccatagcaaagtgaatagcatccctccttcccacacagacacatcaaaatatgtatggaacactcatgactctaatggagagtcaggcaacaagaatgggctaacaaacatctcatggctacagtgaaaatccacccagggagttgtatttgaatcattgtctctgaaacttccagatcacaagaggctgtctcctacagccatccaagatggttagtcaacaacttgagattggtggtgacaaataagaacctgccagagaggtttttaccatcttcaactttgcaattaatcagaactgtttccagccttggtaattatttcagcaaaggaagcaattaagaaaaatgtcttattttgcagaggattcaaaaccaatcagctgccgcatccataggtcaaaaaataacaattttgttctatttattcagctatgcttcaaaaatggaataactaaaataattatatgttttttaaaaaatcctatcacattaaaacaacatttattatttttctgaaaaaagaaatctttttctacctaagttgaaaaataagcatatattcttcccaggtggtaaatttaacaaaaaacacacacacaaaaaattgttttgtgtaaattaggtaaaatgtgtgcatacatgcatacgcatgcatgatttataagtacaccaaactataaatgtaacacattagtaccagcatgaatcacaaaggtagcacaattttatagtcttaaaatcctaattagcataaaagggaaaacatcgtaatcaaataactattgattaacacaaagccggatgtgttgaatgggtttagtaattaactaaggaaactgcaggtgtttaaaactcatagattactaatgaaatgtatacttatttttaaaaaaattacctgtagctgaatcttatcatattcagatacagcaataacacacagtactcatagatgtaaactatactgtcacatagaatacttaaagcatcccttattaaatgtcttaggtgttcaaattctttgaagcttttgctaggctgttttcacaaggatatatctgattctgcctatggatctgacacactttaaaagtagacaaagcagtataaaggaaagcatggataatgaatgaccaactaagaaataatcacagataagagaagaagagcatgacatttaaacgaaaatgctttctagcaaactacagattttttctaacttcttactgtgttttctctgcattccatcaaggtggtccagcagtaaaagtagacttcttcacatcactttgtgttataggactaatgatttcttgagttattggtaggaaactggaagcttttatttggtcccttccaacagaaccaaatgacacggacaagctaactgaaggaatgaaattaggttgtttttaagcacggttcatttccttttagtattgtatactgtctcgcttatttcgattatacataagaaagtatgcttatcctccctatacttatttattatttttgtttttaaattttttatttttaatgtttgtgagtacgtagtaggtgcatgtttacaaggtgtatgagatattttgatacaggcatacaatgtacaatacttcagagtaaatgagatatccatcacctcaaccatttatctttgctttgtgttatcatccaattattctgtattagttacttttaaatgtacaaaaactattgttgactgtagtaaccctgttgtgctatcaaataatagttcttattcattctatctaactatattttggtaaccatttaccatccccactacaccctactacccatcccagcctctgataactatcattctactctatatcctaatgaattccatagttttaatttttacctcccacaaataagtgagaatatgtgaaatttgtctttttgtgcctggcttattttttttaacataatgacttccagttccatccatgttgttgcaaatgacaggatctcattctttgttatggctgaatagttctcaattgtgtatacataccacattccctttattcattcttttgttgatggacacttgttgccccaaaatcttggctattgtgaagagtgctgcaataaacataggagtgcagatatctctttgatataccgatgtcctttctttcgggtttacacccaccaatgggattgctggatcacatgatagcttttttttttcagtttctttaggaacctctgaactgttctccacagtggttgtgataatttgcatttccaccaacagggtacaagggtttctgtttctccacaccctcaccagcatttgttattgcctgtcttttggatataagccattttaactggagtgaggtgatatctcattgtagttttgatttgcatttctctgatgatcagtgatgttgagcacctcttaatgtatctgtttcctatttgtgtcttcttttgaaaaaatatctattcagatcttttgcctatttttaaatcagattattagattttttccaatagagctgtttgagctctttatacattctggctattaatcagatagatagtttgcaaatattttcaccctttgtaaggattgtctcttaactgttgattgtttcatttgctgtgcagaagctttttaatttgatatgatcccaattgcccatttttgctttggttgcctgtgcttgtagggtattactcaagaaatctttgcccacccaaacatcctaaagggtttccccaaagttttcttttagtagtttcatagtttgaggtcttagatttaactctttaagccattttgatctgatttttgtatatgcagacagataggagagtttcattctgctttcccaacacaatttgttgaagagactattctttctccaatatatgttctttgcacctttgtcaaaaatgagttaactgtagatgtacggatttatttctgggttctttattttatttcagtggtccatgtgtctgcctataccactctgttttggttaccatggctctgcagtataattttaagtctggtaatgtgattccttccattttgctctttctgttcaggatagctttggctattctgtgtattttgtggtttcatatacattttaggattttttttctatctatatgaagaatgtcattgatatttaataaggattgcattgaatatgtagattgctttgggtagcatgtacactttaacaacattgattcttccaatgcatgaacatgacatatcttttcattgtttgtgtgatctcttcagcttctttcaatgttttataatttttattgtatagatatttcacttctttggttaaattaatcttaggtatttattttatttggggctactgtaaatggaatactttcttgatttctttttcagtttatttgctgttggcatatagaaatgctactgattttgtatgctaattttatattctacaactttactgaatttgtttatcagttggagtctttaggttttttctaacataagattatatcaattgcaaacacgcataactttttccttaccaatttggatgtcctttatttccttctcttttcctattactctagctagttcagtggtgaaagtgtgcatccttgttgtattccagatcttacaagaaaggctttccatttatcttcatttagtataatactagctgtgagtctgtattatatggcttttcttaacgttgacgtatgtttcttctttacccaatttttagaggattcttatcatggaaggatgtagaattttatcaaatgatttctcagcatcagttgaaatgatcacatggtttttatccttcattctgttaatatgatgtattgcattgtttggtttgcatatattgaactattcttgcatccctttatttaatctttacatccttatatttattatatttataatcccatgtttatgaaggaaattcaatcaataattaatacccttcataaacagacagcatcaggcccagatgagttcacaggtgaattctactagacatttaaagaagaaattatgctattgttctatgacctcttttagaagatagaagcagtgaggttactccctaagtcatactctaagaccagcattactgtaataccaaaaccagagaagaaaatgacaagaacaggaaactaccagccaatatctctcatgaacacatatgcaaaaatcattaacaaaatattagcaaattggatccaacaatgtgcaaaaagaattacataccacaccaagtgggatttattgcatgtatatgaagatgatttagtgttaaaaaatcaattaatgtaattgaccacatcagcaggctaaagaagaaaaattacatggtcatgtcaatagatgcagaaaaagcatttgacaaaatccaatatgcagtctggtaaaaatggtcagcaaattaggaatagagggggacttcctaaatttaataaaaacatgtacaaaaactctattgctaacatcatacttaataatgcaaaactacaatctttcccactaagatcaggaacaaggcaagaacgtcccagctcaccactcttttttaccatcatactggatgttctcactaaggcagtaagacaacaaaaggaaacaaaagatataatgattggaaaggaagaaataaaactttgttcacagatgccatggtcatctatgtagaagatcaacaaaaacaacaataacaaactcctagaactaataaacaattataacaaggttgcaggatagaaggttaatatataaaagctaatcactttcctatatactagaaatgagtaagtggcatttgaagttaaaaacacaataccatttgcagtagcacccccaaaatgaactatataggtataaatttaacaaaatgtgtataagatctttatgaggaaaactacaaaattctgatgaaagaaatccaagaaataaataatggagagatatttcatgttcatgggtaagaaggctcaatattgtcaagatgtcagtctttcccaacttagtctatatattcaacaaaatcttaattgaaatccaaagttgttctgtggatatcgataaactgtttctttctttgttttttacttaaaaaatctgttttattgaggtgtaatttatatactataaaaagtacccatgtaagtgtacggttggatgagtttttcttttcactgacataatctttgcaaaagttggataagttttgcaaaaatataagttttgtaactatattatatgggtctatatttggcctttgaattgataaaggcaatataatggaagccaagatagttttttcaccaaatgatactataacaactgggcaaccacttgcaaaataacaataatctagacatagacttcatactcttcaaaagaaataactcaaaatggatcacatacacaaatgtaaaatgcaaaactatatactcctagatcatcagagaaagtctagatgatcttgagtttggcaatggcattttagatataacatcaaaagcacaatacataaaagaatgaattgattaaagtataataataaaaaataataatcataaaaaaaagaatgaattgaaaatccggacttcaattaaattaaaaactccatggccgggtgcggtggctcacacctgtaatcccagcactttgagaggccgaggtgggcggatcacctgaggtcgggagttcgagaccagcctgaccaacatggagaaacccagtctctactaaaaaatacaaaattagctgggcatgggtggcgcaagcctgtaatcccagctactcaggagggctgaggcaggagaatcacttgaacccaggaggcggaggttgccttgagcggagatcgcgccattgcactccagcctgggcgacaagaacgaaacttcgtctcaaaaaacaaaaaaacaaaacaaaacaaaacaaaaaatactcctggccgggcgcagtggctcatgcctgtaatcccagcactttgggaggctgaggcggtcggatcacgaggtcaggagatagcgaccagcctggctaacacggcaaaaccccgtttttactaaaaatagaaaaaattagccaggcgtggtggcgggcgcctatagtcccagctactcaggaggctgaggcaggagaatggcgtgaacccggaaggcggagcttgcagtgagccgagatcacgccactgcactccagcctgagcgacagagcaagactccgtctcaaacaaaacaaaaaacaaaacaaaacaaacaaaccaaaaaaaaaaaaaaacaaaaaaaaaaaacctcctgctctgcaaaagacattggcaagagaataagacaggccacagactgggagaaaatatttgcaaaataaatatttgataaaagagtgttgtccaacatacacaatgtactctgaacaataaaaaagaaacgatttatttagaaagaagcctaagacctggacagactcctcaacaaggaagatatgtagatggaaaaaagcacatgataatatgctccacgtaacagttcatcacagaaatacaaattaaaacaacaacgtgatgccactacatacctattagaatggccaaatccagaacaccaacaccaccaaatgctgggtaggatatggaccaacagaaagtctaattcaatactgggtgtaacgcaaaatggtacagctactttggaagacagtttggtagtttcttaaaaaactaaacgtactcttaccatatgatctagcaattgtgctccttggtattaacacttgtgtccgcataaaaacctgcacctagatgtttattacagcagctttatccataattatataatagacatatgatatattatatatatagtatctttattcaacttttaaactttgtataactgaagtaacacagtatttattttttctataagttgtttttgtcaacattatgtttcagagattaccctttttaatgtctatgtaggcctactgaatttatttccacttcacatagcatggattgcattcatacaaattcattaatttttgatagacatttagatggcttccaatctaaatttgaaaataaactactgctatgaacactattacatgtgtacacaggtggatgtgtgacaaagcaaggataaatgcagagagttaaattgcagaatcatagcatatgctcattttaaactgctaactgctgccatattgttctgtttaagattggccgttgtcctgcatatgagtgaacaacatgccacgtttggacaataacaaataataccaagtttgatcacttaccacagcattgctaattttatcagatttataagggaccgactttgtactttattgatcttttctattatattttttatttttaattattttctgctcttacatgtacttctaatatccttattgttgtcttttaagatacttttcatcttctaacacaaaatataatttatttcttgttatatttatattctgaattgctctactagaatttagctccactagagcataaattcttgcctgttctgttcatatattaattgcaaaccccagaacagtgtaggcacaaatatttgttaattaaatgtaaatatgttaatcttttattctaacatctttagtcttgttagtctttaaaaatttttaaactgggtgctcagctcattaatttcagcctttcttcttttctattataaatattaaatgctatatatttttcctaaatgtcatttaatgtattatttctataagtattacttgccatgaaaaagaaatctgtattatgtactttggtgctatatgaattaaccatttacttaattattttaaaaactgctcactaatctttgtaagaattaaagaatttcatttgaatttgcgagattgtgtttttaaaaaatttcttcctttctttttatatttattgcctcacatgttcaataatgaagacttttacctcatcaactcagttatcttgatatacaatttcttactgcaaaagcaaaataaattcttctttccctttaattactcatttttcaagtaaggtgttattttaatagctgttttaactattaacaattgagattttctgcgtttatttttaagtattatggaatcatagattttcactgattcagtgtgttttagtaggcttcaatcattccttttgatgctcaaattattacaactttgggcaatgatagagccttcagagtggctcctacatcctttcaatgtgactcaagactttgtaaaagttttcaggctttcaagcacaaaaatctaccctacactccccttgtttgttccttgcacctaacctagattgggcatttctccagggaagacctggcgctttttagtgaggaatggtatcaaacagcaaaactgaagtgctcattgctctgctagagcaacattgtttccgagccatttcagtggacagggatcacaggacacacacacacacacacacacacacacacacacacacacccttccttctatacaattatttttaatcatgagtgaaatttgatattttcagtttaatttcaataatacggtatttacatttattttctttgatattataactgtcttttctcttacactgaaaatctttattaaatcattgatgtgattacttattgttttaaccctcaatacaaggaaaatgattttaaaataccaaactgatataaatacactagtaaatactgttttggtaccctgttttcatccccttgacaaagccaatgtgacctctcatcagctcctgtagtgattggctgctgatgtctccgggggaacccttcctgcctaggaagttagctcgggctcccatccctgacagcaggccacagctgactgactgacataatagtacaaaaagttagcccccgaaaccgcaaaagccagtgccctttggtggggaggaggagaccactgagtcatggtttaagatccagagccctccactgaaggtcagatcaaggacagactacctgagatcagatccagtttcttttcatccctccctcacaagtctttcttcaagagcacttcctcaaaaattcacttgcaccaaatctcctgtgtcagattctgcttctaggaaaccctacataagacaactacgaacaatgtaactccagagggaggtttgagatttcatttttttttttgcccatagaatgcatctcattaagaatatataatcaaaatgccatattataaagtcactttaaatgctttctgtatgtgtgtatagtaccagacggatatgcaattgggtacacttgggttttatttttaatttaaaaaatgttttaataatttagattttttaagaatattgcacttatgacccaaaagtcgtaactaggaaaactaagaaaactcttatctgcccccaatagatgtcattaattatatttttctccaaaattatttattgtatctagttttcaaattgatttgcatagagttgatcgtattaaactttattgataatgttacattgatttatttttgttttaaatatttctcatttttctttttgatttcttctcaatgaatgaagtcttaccaaaatgtaaaagtttttaaatgtggaattcttttatacatttttttgctattgatacttattttaattgcattattgtcagtccacattatctatgtaatataattttcataaatgcttcatgtgtaattttataatgtataaatgtatattttctaatttaggggcccagggttctagctgcatgtattagatcaaacttgttagttattttgttctaatctgcacccctaatatttttgtttcatctgacaaatattgatggtggacttgacaattactacacacagttctgttcatttttgtttcctatgtattgacactaatgtactgtatacacagttttcacagtttttttattattatgtggggattctctttatgtttttccataaagtctattttgtctgatactagtataattatatcacatttatacctttattatgtatttttctatacatttactttcaatacttctgtgtccagatgcttaaatgagcctcttgtaaatgacacatagctgaaatttttagttgtagaattagtcaaataaatatttattgagattattcatatatgtgttattgcttctaccatctatcttttgctttctattcattgtgatttttaatgtttttttattcctgacactatcattatattttaaatttttcatttattctctactacttcaaaatcatatactcattttacttttattctaataaaacttcaccctaaacttttaccacccacatttacatttaaaattaatcattactgctaccctccacctaaacaatactaaaacctcaccttccttccatcttgcatggcactgatgagcaacttttaattccaccctgtttttgcctcataagttaggcattatttttgtctcatatgaataatatttatgggaatttgcctatcttctaggaccttctttcttcctgaaatacacttaggaagttccattggtggtaaatagtctagattttatttgtctgaaatgcttttgtttcatcattttaaataaaagtttaatcagatatatatctatacgtatatatttctgagttaaatcagcaagagagtaataggttcttgcttccattgttgctgttgacaaccacacttaatcaaacattcttttgttggcaagtttttctcttgactgcgttttaataacttcttttttttaatttaatatgttattattttactgtagtgctctggatgtgaaaatgtctaccattcattaagtttgaaaattcttcaagaacttttttctaatattgcctcctactcattttcttattctcacctccaaactctgatcagatgtgtatcaaaccttctcattctattctccatgcctattggcctttcatgttttctgaatatatagctctttgtgttgaattatgggtaatctcttcaaatacatcttccaaatcattgactgtctcttaaatctgtctaatctgctttttaacctatctattgatttcttgcttcaattatgtttttaatctctagaagttaaacatacctgtttattttaatattctcttccctttagtgatttttcatcccagtttttatttttatgaacattttaagggctgggtatagtggttcacacctgtaatcccatcactttgggaggccattgcaaaagggctgcttgagcccaggagttcaagacctacctgggtgatatagtgggacttcgtctctaaaaaagccttgaaaaatcagccaagtgtggtggtgcacaaccgtagtgtcagctacttggtaggctgaggtgggaagatcacctgagcccaggaggtgaaggttgcagtgaaccgagactgagcctctgcactccagcctgggtgacagagcaagttcctgtctcaaacaaacaaacaaacaaaactttttatgtaataattctaaaatctaaagttgctgattcttaaattgtgctgtttacatatttcctgttggctgtttttcatataattttttttccttttggatttggcaaatttttactatgggaaattattagaactatttagtcttaatctttggaaaacctgagggatctagttttaagataaattactttagaaaggaatgtttgaatttcccctgataagtcaggaagaatgcttgaacccattcagaattccctttcttatggtaaatttcttctcagggaattttaccttttcctaaaatcttagctcgatttgaatactccaagagaaataagaaaaaccaagagagaatacagtcacggaaaggagaatgttttgagaaaaagtcaggagttagtaatgtcaaaaactgctgaaaggcaagaaagataaatgccaagaagtctgtgtcatatatagtgatatctgtgaatttagccagaatagctaagagtcacgttatcatctgaaagccaatttgctaaaatttcatctttcctttatttatgaagttaagtttcactggatacaaaattcttcactgataattgttttgtttgaagaggctgaagatagggctccaatcccttctggcttgtgcggtttctgcttagaaatctgcgttaatatgattggtttttctttctaggttacctgatgcttttgcctcacagctcttaaaattatttcctttgtcttgactttagatacactaatgactatgtgcctaggtgattatctttttgtgatgaatttctcaggtgttttttgagcttcttatatttagatgtctagatctctagcaaagtcagggaagttttccttgactattccctcaaatatgttttccacaccttcagatttctcttcttcctcagaaataccaattattcttaggtttggttagttaacataatcccaaacttcttggatgctttgttcctttaaaaagtttttcttttctttgtcttcgctggattgggttaattcaaaaacctttctttctttctttctttctttctttctttcttttttttttttttttgagctctgaagttctttattctacttgttcaattctattgctgagactctccagtgcattttgcatttctctgagtgtgtcctttatttccagaagttgtgattgtgttttatttacattatttatttctctggagatttttctttcatatcctgtaacattttttaaatgtctttaagttggcattcacctttctttggtgcctcgttaagtaccttaataatacaccttctgaattctttttctggtgattcagcgatttcttcttggatccattgctggtgaacgagtgcgatcttttgggagtgttaaagaaacttgttttgttatattaccagaattctttttctggttccttcttgtttgggtacactatattagagggaagatctggggctcagtagctgctgttcagattgttttgtcccatggtgtgactccttcatgtggtgctctcccccctttccctaggaatgggacttcctgagagctgaactgcagtgattgttatttctctcctggatctaggctcccagcagagcctcctgggctcaaggatggtactgaggagtgtctgcaaagggttccgtgatgtgattggtcttcaggtctctcagccatggataccagcaccagccctggtggacgtagcaagggagtgaagtggactctgtgaaagaccttggttttatttttgtttagttttctggttttgtgtttgttggcttccagccaggaggtagagctttcaagacagcatcagcaacagtagtataggaaggatataggcttgccctagggtcacctggataagtttctcaggtagtgggcaggatcatagagctcccagaggattacgtcctttgtctttgcctaccagggtgggtagagaaagaccttcagatagggagcggattaagtgtgcctgaggtcaaactctccttgggcaagtcttgctgtggttactgtgggggttgctggtgtggatttcaggccaatggagttatgttccaaggcagattatggctaccactgctgcagcatacaagttgccaaggaagtgggcaaaagccagcagtgacaggcctcactcagctcccacgcagcaccaaagccccgactcactctcaccatgtcaccgtgcccacgcaacagcaccaagtttatttccaggcagccactaagcagggctgagaacttgccccaggctaccagcttcctcactgagaaagcaagcagggctctcaagtttcacacatccccacctgccaatggcttctgtgctgtgtctgcattcctggttcactctctcccccagattctgtccaggaaaacttcgcattcagtcaaaattgttacaaagttcagctggaagtttccttctccctgtagtctttccctaatttgactggcgagacacaggaccccagtgagacaaagtcttaagtggcttccctggggactgagagttcctacagggcttctctcaatgcttcctctagccctatattttcctcagctctctaaattcatctcagctccaggtaaggtcaaattctcccatgatctggaccttcaggttccccagtgaggatgtgtgtttggaggtggacatccctcttccacccattgggcactcacagttttttggctttctcacagaacctatagcctcaatctgcttccaccaaagggtctgtggattctcttggctttttgttgtgttcctgcagtagaccttggagcaaaagttcatgatatgagtttccatcaaaagttcatgatgtgagctcctgagtgggacccacaagttagttgtgcctgctgtctgccattttttcctgccaacctctcaaaattgcccttgtttgatgataggaatgagcagaagcattgtcatggtggagaaggaccctggtgaagctttcctgaatgtttctctgctaaagctttgactaactttctcatatcacttttacaataagcagatactattgttctttggctctccagaaagtcaataagcaaaatgacttgaacaccctgaaaaactgttgccatgacttttactcttgactggtccactttggctttctctggaccacttctacctcttgttagccattgttctgattgtgctttgtctttagaatcacactggtaaagccatattttatctcctgtggcaattcttcaagaaaatgcttcaggatcttgatcacacttgtttaaaatttccaataaaagccctgctcttgtctgcagctgatctgagtgcaatggttttggcacccatcaagtggaaaatatcctcaactttatttttttagtcagaattgtgtaagcagaaccagttgagaaatctatggtgttggctatagtatgtgctgttaatcatcaacccccttcaattagggcacaaacaagataattttttttccttacaaattgatgtgaatgatctgctggtatgagcttcatcatcaacactgtcttgtctcttcttaaaatgagttatcattgatgggcatttgggttggttccaagtctttgctattgtgaatagtgctgcaataaacatatgtgtgcatgtgtctttagagtagaatgatttataatcctttaggtatatacccagtaataggattgctgggtcaaatggtatttctggttctagatccttgaggaatcgccacactgtcttccacaatggttgaactaatttacactcccaccaacagtgtaaaatcgttcctatttctccacatcctctccagcatctgttgtttcctgactttttaatgatcaccattctaactggtgtgagatggtatctcattgtgattttgatttgcatttctctaatgacagtgatgatgagcttatttccatgtgttttttggccacatgcatgtcttcttttggccaggcacggtggctcacacttgcaatcccagaaatttgggaggctgaggagggcagatcacctgaggtcaggagttcaagaccagactggccaacatggtgaaaccctgtctctactaaaatacaaaaattagccgggcatggtggcatgtgcctgtaatcccagctactcgggaggcagagacaggagaattgcttggacctaggaggcataggttgcagtgagcccagttcatgccactgcactccaccctgggtgacagagcaagatactccatctccaaaaaaaaaaaaaaaaagtcctcttttgagtagtgtctgtttatatcatatcctttgcccactttttgatggggttgttttttcttgtaaatttatttaagttccttgtagataatggatatttgccctttgtcagattgataaattgcaaaaattttctcccattctgtaggttgcctattcactctgttgatagtttagtttcttttgctgagcagaagctctttagtttaattagatcccatttgtcaattttggcttttgaaatgccctccaatgatagactggataaagaaaatgtggcacatatacaccatggaatactatgcagccataaaaaaggatgagttcatgtcctttgcagggacacggatgaagctggaaaccatcattctcagcaaactgacacaggaacagaaaaccaaacaccacatattctcactcataagtgcaattgaacaatgagaacacatggacacagggagggaaacatcacacaccagggcctgttgggggttggaggctaggagaggaatagcattaagagaaatacctaatgtagatgatgagttgatgggtgcagcaaaccaccatggcacttgtatacctatgtaacaaacttgcacattctgcacacataacccagaacttaaagtataatttacgaaaaaaaaaaatatatatatacacaaattaaaaaaaagaattatctatttgtaaactgtggatttctttggagcattgtcctcataaactttttgtatagcattaatgatttcagcattcttccacccaagcttcactgcaaatttgttgtttgttcttgtgtttattttaccagaatttatgttgctctgataggggctcttttcaaactgatgtcttaacattctcattgcttcaaactagagcctgttcagacatattacaacaagttagtatgagtttattttggtgcaaaaaaattgaaatccatgcataggtttttttttaaaataatagcattttccatgaactttttaaagatccctctacctgttaaatggatggataaggcttcattgctccctgaagtgatcgtatctaaggaagtaagccccaaaatgaaaataaaaggctcgataacctttagctctgactcttgtctataattaatggtaaagaattgaaaaattctagcaatacctagttgtaaagataagaaagaggagatcaaaatgatcagtggccactcctcaatctgtaggctgctctttatagccaacatcagtggcaaaagtccaaatgattatgacttgctcataaattgcaggataaatttttttagaaagcaacaggacatgacagacactcctaatgaaaacgtaaataccttttaagcctatctgtaagagatgcttttaatgtagaaaaatatcatataatttttgatatatttgaactaattctaagcctttgtattacaagctccaaacacttaaacctatcaatcactctatttgctctttattatatagatccatagtgctctatgaaatatttagtgtttcaggaaaaagaaaacaattagaaaaataagacatttgccctaactattctaatttatattctgagacgaaaaaatatttcagaagaagttcaattggcatgaattctactatataaatataagatcaaagcacactctgtaaaattgaacaaaatctggtttcttaagtatatatgggcttctctttaaggtcacgttttcacttacagatgggctgacttgtgatggaaacaaaagtgaaaagacaaagaaagtagatggctatataaaaatgaatgcaataactttttgagctgcaactaaggagaaaggcaaaaaaatgattattgttagaagttaggagtccatttctagaaatagaaagcattacatttaaattagacacatacccaaaaaaaggagattattaaaagagcaaagaataataatagagagactagctccttgactaatgagaaattgtatagtggtatactgtaaagaagtgaatattgttttttttagaacataagctgattctaatatagcaaccacacttactatgaataaaatgtgtgcaggcatatgcacatacatagttaatgaacaacatttcaaataattctgggtatcttttttaattgaaatatttggagaatatgagagcaagtttggaattcacactaatgaaatgaaagagctcaaacatttaatgtttacttaaatatattttagggaaaaggtagataccatggaatacatttcttttaagtcataactctgtgaatatataaggtatacctcacacatggttatcaggtgctttttctttttctccttgtccacccttaaagccaccatttaatgttcttactaccttgactcctaaactttatgaaaaaaaaaaaaaacaccaaatcttctcctcttagtttctttatgtccttgtaatccagttttttactcccagaactctcttggaattgcattttgtaaggttgtctattgccccaataataagaaaatttagtagtcttttttaggagactttgagtctatgacgttacagacttacctgaaattctcttttctattgtccttgaagttctgaacactgcactccaatatatgccattctggcatattgattgttttgagttaaagaggaagtgggaagggggagagggagaaagaaaaaaaaagaatgagtgagagagaagaaagagagagaaagaaggaaggaaggaaggaaggaaggaaggaaggaaggaaggaaggaaggaaggaaggaaggcaggcaagcaagcaagcacactccaaccttcctaaaagcaggagataaaactcccatgtggaatgtcttctcccctccactggaagaaggaagaccttcttatcaccagagttgaagagtcgaggctgagagaaatctccaccaacaacctgtattaaactaacccttatcttcctagccacttctctgtaaacaactacctcagcccaagcccccttgctttgttacattttcacaatttaccactctttttccaaataagtatataagttgtcaactctaattgcagctttgtgtttttatttccttatgatggctccatgtcaggtaaaactgataataaatttgtacgctttgctctcctgttaatttgccttgtgtaaatttaattctcaggcccagctaaaaactctaagagggtaaaggtaaaattgtgccttccctacaaccttaacatgctgtcttgtctctaggctgccctcacacctcccaaaccctcctacttggttttatttttgggtttctctgttttctctttgccctcttcttccttattctacaaactattccttgatcatcacgtatgtaaagcaggaaaaataattttttctctacccttctgagttcttagctgggactctttttcacaaaaggcagattaataagaaacttgaaacaagcagaattttattaacatgtatatcttatatatatatatatataggtgatactcaggactaaaagactaattcttaaataggtggcttagaattcaggcttaaataacatcttcaactgaaaacaaagaaagaagagtgtggggcaggctagttataggaaacttatgacagataaaaactagttagtaaagttcattatgtagatttctctgatgccctctccaggatgacaaaggtctaaagtaatctcaggtagttaactttagtttttactggtagagaaggaaggagggacatcattgtaaatttatgtcttgcttttaggcaaataggaaaaagacagagagatctgtatatatctgcttcttctcagttgccttcagctcaaaaaatcctcatgccaaagtggaacattttggggtggcatattctgctaccctggacatatgcttgcataaatacaaatgccattgtttatatctttttaactctaaagacaaaagcaaagacaccagttgtatcagttgtcaaccttctcaactgtgatgtgcttaaatcatcacacagtagtctatttccaagaagtaaaagagaaatggcatttgaactactgacattatttttaagattaattcattgatttatggtttagcattaacccattgtattagtctgttctcacactgctaataaagacattctagagactggataatttataaaggaaagaagtttaattaactcacagttcagcatggctgggaaggcctcaggaagcttacaaacatggtggaaggggaagcaagctcatccttcttcacaggagagagaagaatgagaaccaagcaaagggggaagccccttctaagaccattaaatcttgtgagaacttactcactatcactagaatagcatggggaaaaccacccctatgactcaattacctccaacaggtcccttccaccacatgtgagattatgggaactacaattcaagatgagatttgggtgggggacacagccaaattatatcacccatgtatttcaaaactacacactttgatgtggtaactaaaagcttcaacaataaagtgatttgtgtttctttttctgtataaaatgttattttctgtgtggtgtttcctttgatataccttgtatagaaaactgagttgtcatgtggtaagtttaaaaaaaaatgtttctaatctagtactgaaatagatagaaatcagacacaaactttagataaaatgttacagtgtaggtgtggaaagggtgtgatacttttttccccgttgaaagggtcacagtccacactcctaaaacaaaagagaggttaacaagagaaaagcattatagatttattcaatcaaagttttacatgtcatgggagacttcagaaatgaagacttaaagattcagggaaaactgtctatttttatgttttgatttgatgtagaatgcacaaccatgtagaaagaagaacagactcaggcatggtggctcatggtcctagcaatggtcctagctatgcaggagtgggaggcaggagaatttgcttgagtccaggagttcaaggatggaatgagctatgttctcaccactgtactccagcctggtcaacagatggagactatctcaaaaataaaaaataaatatgattgaaccaaaaaagtaggacctaatggtaagagactgaatggggaaacccaacaagacctgtctgctcagattcttcttggcttctctgtgtggcatttcttcttcctaggtatagggtaagacctttctggagtaacagtcttatgtctacctttagacaaggtaagtcagagaatttctttattgctagctcttacacagaaaggcaagtgatagagtaatatttctagattttatggccagctgtgggagaaaagggttctggttcgttctggttctatgacctgtcttagggaagaggaatactaatttctatggcctgccttggggagaaaggaaagcaggagaaagaagggcagaagaaggttagaaagagactttccttctgaagttcttccagtgtccttcatgttcaaagtactcagcatgccaaatcactatatttgggggtgtcattttcagagctcccacacaaaaaacttaagaagtttgaagtttaagtataatttaatgttatttatattctcattcaaattttaatatagtcattgtgaggaatagtaccatttataaatatgttatagttccaacaaatttaatgatacctatgctgaaaggttttatgagtgtaacaaatatgtatgattagttcataaattgactcttgttttatttgtataatataaattttagttaaagtcatactgaagtgaactcacagtctgcaataggaaaggtcgctgggtaagaatgcttaaggaatggaaatcgctatgaattttgagatcatgctagttcatctcgaacctggtgaattctattaagatgagaaataatgtatagttcttctgtaatgagcacatctaactgtaagaaattaaatctgatgaccaaaaaagggagcaatcagtgtgcatctctgatgtttgtgtgcaggtaaattgccttgcgttaaactgaatttggtagctgaagcaattatttctctataatattttcccttcagagagtaactgcaaatgatacaagtagcaaaccaacaaccaaaaaaatgacctaaacgttttattatcaataaagtgctacaactgtgaaggtaactgaatagaaaaccaacaatcaaaaggaaaaaggcataacatgttttattattgatataatttgaggcatacttataatgatactttgaattccttgaattgaagaaaatcgaaaactgcatagtaaccctgcctacttatatgcactgggaatgttactacccttgtgattcacttaccatatacagcagtgtaaaaagagggtttccctactgtccttttcagagagctccaccctgattactttcagtgccacccatgtgtaagttcaaggctttccatttcccactagcttcctctaagttttcagagttccaacctcaatttcaggcatttaggtgtctccttggcaactgaagtggacactgtcctcaaaggaaccttggaatgcactgacgtgtgtcagttgtgctgcatagtctgcgggcagcctctgcacctctcagcaaaagtcacgtacggaccctgctccaacatggccccctggcactaagacagagctcactgttggagggagtggaggctggaaaataaacaaaagctgactctgctcctgcatccccagctaccctgcagagcagtgtccttgcccggggactgctttggcctctctccatcaccactacttcttctacccaatctacatgggtggttgcagtctttggattatttggaagtcaaggtcctggtccctaatctgttcttttcaatctattgtttatgaccacaacattatgatcttagcccttcatacattaacaccccagaaatactaaagggcatctcttaaggatcaaaaaccaggctattttttccattaagagctctgaaagtgtattttgatatacataaaagttaaggtttgtcttctttgttcttgtgattgactgtggtgccattttcttgaaacaactgaggaggaaggacctggctgtcttcagagtataaggaatgatcagggctttggagggggaagacagcaagtaatgtgagagagtgccgcattatagctaaaagtaaacactgcacaggattacatcccagctccaccactaactagctatgctaccatggacaaattaaattacctcactgtgacttacttttctcaccaatattagtttctcatgactgctttaacaaatcatcacaaaattgatagcttaaacctcagaaatttattctctcactgttctgaaggccagaagtctgaaatcagcttcactgagctgaattcaaggtcttggcagggccaaactctctctgaagctttagaggagaattcttcctggcgtcttcccacttttggtggctggcagcaatccttgctggctgccacatcccagtctctgcttctatggtcacattgcctttgcctcttctaccttgtgtctaatctctctctgcctccctcttataagaatatacacgattgcatttagggtccactcagatagtccatgatcatctccccatctcatgatcctaatttaatcacatctgctcagtcctttattgccttataaggtaaaattcacaggttccaaggattagaagctaagtatcattggtggaggcaattattcagcctgctataaattagcttgatcattaaagtgcctacatgaacattcaagaatataatatgtgaaattcacttagaacaacatctaccatgccataaaagcattcaacaatatttatcctatgatagtgatattcatgatgttgcagcaacaagaaaatgcagacaaaagtttcaaggtagaaattatttttaaataaatgtatatggaagatctcatgtctggattttttaaatatatgttgcccttaaaatgttaatagtaatcaaaggattatctccccattgaataactataacccaatagtttaggcatataatacatgcagccacttggggctttgtcttttgttacttttcacttgaaattgaaatcactgtagcaatttcatctaccctgaattcttcctaaggtcaaagtcaaagacgtgatgtaatacaatttcctcattttgctcttttgtctcctacccacctaggacaccgatctaatgacattcaatatctctgtacatcggtcatggtggagagaacatgggcctggttgtgtcagaagagtgctgcctccctcagcccatggcatgatggacgattacacgtacgtctctgtcacaggctgcatcgttgacttccagtacctggaggtcatccacagtgctgtccaaatactactctctgtaagtgtcacttttgtgtcattatctaatcagaactcttctttgctggcatttttttctccacatctacctgatagaaaatgccacagataagcacacagagaacatccaacagaaatagaagcaattatggtaccactagttatacctgatggcaggttacaccttttttctcttggtatctagacattttgtatttagaagcagttagtgactatcatttctaacttaagatacagtccacactattcaatgaaacagtatcaccatccaccagaagtggtcccttttcacttaactacctcaggctcttctactaatgcattcttcgactaatgcacctcagttccagagaaagaaggatggaaacacccacagccaatggcttgcttggtctaataaacctgacatttcatttattccttaaaaaacaaatcccactggagactcttcgcattttagtgcctaaaatctggcatcagaatacaattccatatacagaaacgagaaggaaatgatgtgattagtccacagaaggttaatgtgccagggattccttaaaagtaattttattccaccagactgccccactcacagtttgaccacaatgaagagtggaattaatttaaggatgtataacatcatcaagaacaatgttcctttcagacccgaaaaggacttatcatttagtttgagtcaatatccaataaagccattctcaacccactcttcacataaaccaaccatctcagttctgttcaactgagcttagcttagtaggaataagagacacagactcaatagtaaataaatagataacacaaatatgagtggttatgtcaatgaagaaggtaccttggaattaattctagaaaatctttaagaaatccttgctatcacttactgtattcattatctactactatgtaacaaaccactccaaaatgcaattgcttaaaacaatattaatttattgcttagagttctgtgcattaggaatttgggcacatctcagccaggtagttcttctgctttatgtggtattagataaggtcacccatataaactccacacaatattggctagggtcactgatgtgagcctgtcaatcttgagctttgctgggactggaatgtccaaagaggcctcactcacatctctggtgctggctgttggccccattctcctgcacatgcacatggcttctctttctgggaaaaaaaaaaaattgaccgattctcaggcaacaaggtagctgaataataaaaggtgaagtcaacacgcaagcatttgtcaagcctctacgtgagtaatgcttgctattgcttcgttggctacagcaaatctatgactcagcctgtagttaatgtgagagggggctatcaaaaggtgagaagacaaggaggcatggctcttctagggccaccagtgtagtgatcttacctcatttactcaatctactatttactattcttgaatttgcatgtctcaagttttaaaatgatgtttcagagcacatttgaattacaatcttctagaaagactaaagatctgaataaaacaaaaatcaaagatcttttagagttctagttcaaagaaaggcaaatttgatactgaactcaaagaaagggattgcaccttgatgggaaggaatttcttttcagacatgcaacagggaatctgatcattctaggtttctacaatcatatttacaggtataaatataatatacagtcacttgccaatatatgcttatcagtcttttcttattctctgatcctttgttaatgtagccattacatacaaaattgtggcaaaatatatatgtttaaatttttgtcttgaaaaaatgtggaggcaaattttcttttaaaaatgtgtaggctattttaagttataaaagaactctattatcctatactagatactaacagtttttattaatcatcttgaacaatgaaaatgtttttctaaaatctttcatatgtggacagattactctcctttaaaaaattatcgtagcaaattgctaaaccattttgtggaatgatagcatggccagacctttacaatgcagcaggacgcttggaatccaaaagtcatttccccatagtaactccaattcaaatgaacagcaagtatttatttgataaggagctggagtgtcacataaaaacattccctaaaggacaatctaaataaactgtatgtgttgccacctaaaagtacttttcccttataaatgaatttctccacgtgttattttagtaaacattcaaagctaccaccctgcacatatagctctatactcttcagcctttgagaaataaaagattagttgctgctcactgacttttcttggaacacacctgcaggacaagatttttaatattttatctttttatattaaagtaaaatatatcaagaaattgtttcacaactatccaattatgtattagtggtgtgactgatttttgtatgggtttcttgtgtttgtcacttattttatatgattatgtatacttattagaattgtgcttttttcttttcttttttttttttttttttttaagacggagttttgctcttgttgcccaggctggagcgtaatggcgtgatctcggttcactgcaacctccgcttcccaggttcaagtgattctcctgcctcagcctcccgagtagctgggactacaggtgcacgccgccacgtccagctaattttttgtattttcagtaaagacggatttcaccatttggccaggctgttcttgaactcctgacctcaggtgatccacccgcctcggtctccgaaagtggtaggattacaggtgtgagccaccaagcctggccagaattgtgcttcttaaacatttgattcaggagaatccttcttgttgcccaatatgtgctgaaatgtttaccttattactgaaaaacaggggtgatggtcgcaatatttaacagcccgaggggcgtgggcaacaaccaagcaaatagaggggcagcttcgagaaagggcaggggctcggcggctctgctgcagggaattacccctttcattactggaggcatagaaatatctagaataacctaggggagggactgacggaggtggccaggaaggtgatttcggggagcgactctccaccgaatgagagggaagtatttgagtgctttgaccaccgacacatctcctccatgaatacagcctgagcaagtgcctcgcgtgagtggagcttggaactggaagaaaagtcacctctgtcataagcattccacagactgtgtacatgcttgacggaaacgaatacaattaactggactcagaaaggcgaagacgggcggggttccttaccaggctgttgcttggggctcagggagcatccccactctccaccgcctgtgccttgcttggcgcagaggcccccagcttctgccggcgcctctgtccctgggaggcggcggggggtgccacgtgcatcctcccccggctctcaggctgagaacgacagggagagtgctaggcacagagaaggttcttgttgtcctaaagtcaccaaatcctgaagaagagttcctgcaaattgtcagcaacaccaaggtgaaaatcagcgcggaatccatagaaaggttgtggatggtattgtgggggagcagcaaaatgcaatccatgctggagtggagaagtcaaagacaagcagactccggccctgggatggtgagtcccccgctctgtgcccactgcccgtctctgttcatatgctcatcacttctcacctgaagctggccagtaacctcctaaataatcttccccaccaagttttgccctacacttcatgcatgcctcctgctccctgtaagatgatcacaaagcgcaaatcttatcagtcacgttccttccgatcacccttcagtgattctcatcaccttcaggatgaaatctgaattccctactgtgcaagggaggccctcgtgacctgcgccagcctaactcccaccctccccttctggcatccagcaaaagaacccttcctgtgccatcctcaggcagcggcctgcatggaatgggttctcccccaagtcccttctccctcctaccccacctgggctccttatccacctagctcctagcagacatcttcccccaaaacacctcaggatatgttaatttaattttgttaagtagttaatacatatacttggttcgaaaacatacaaatgtatacattaaaacctctgtccggcgtttgggccccatatgcctggttctcccatctctgtttccaacaggcatccagttttactcttttttatttatttttgtacatgagtccaaagtgcctttatgcaagtgcaagaaaatgtgactatatattcttatttgctccccacacaagctaacgtatgatatgcactcttctgagcccttctttttattcttatgtattttgtaactatttccttatcagtactcaatgtatcattgtttatttaatactcttctattaaatatattgatggacatttggactctatccaaatatgaaaataacttcagatgtatacataacacatctatgtgtgcatatatatactatagcgagtataatatatagatagtatgtgttacatattataatcatatgtcatatagctattatacacaatgttatactaaaaaactgtgtgtgtgtgtgtgtgtgtgtgtgtatgtgttactgagagcatttcctagtcctctcccactcactccctcaggctgtactagatgccctgacacctgagcacactataatcattgagtttctattctatctactggaaggaaagcttcttgcaggatagaattgtgttcttttttcacttgttcatgtctgtggtttcagcaactaatgcagtgatggcacataaatatttgttgaatgaataaatgatcaacaaacaagagactctgaagtcccaaaagggtgaacacaaaaggaatctattgagcaaaaaccagcaggagtgaatgcatggacaagatgtaggagccagagtgaagatgcccttcatctgggaagttaagagaatgtcagtaaaatgttctgtgcagggcatagcacagaagcattcaatacatactagtttcacattgctattactaatgttattattacactgccctgtgcttgtccttatcctatttaggctggtccgtcttttgaaggccaaagggctccattctggtggcactccatctactgaattctcatttctttaatcccacaccagacaactgtttcctgcatgagaacataattcctgtgatcttcataggacacggcaatcataaatccctattaggagggctgaacttttacttaatatgtatgtattttcctcaatcttgtttcccagaattctttcctacctgtgcctcacaagagcatttgttggactgaatatattctcatattttcatgaaaaaatatcagaattattacagtggaacaaagatttcagtagcctgtcaacagccagtagtgtgctcctaaaagctactctttaacttcttatttatctcccattaactagaactgtactgagtgcagagtggccactctttcatagttattgagtaaattgttgtatacattttctggattttagatttacaaaacccaaagtatgtaaaattttttttaattggaagtaatttaatgaggctatgtcttgattttattttataccatttgataaaaactatagagaaaacatactgtcaaattatttctgatgcagacgcaatttgtttggattggtaaggatacctagctacaggaaaagggacagtcaatctgctccaagattgtaactctatctttgaatttgttcttccgcatgttctttattttgagagttattttaataagtttagactaccttagttgctttgcttccagtggggggatttcaaaacagtttctggtgaaaattaaaaactatgtctagttgaattctaagcactgtattttaggcatttttaaattacattcttactctgggaatttaataccacagatttaaagaggatgcacacacacacacacacacacacacgcacgcacgcacagtatagcatttcctttttctgctagagaatgtgaataaagtatttctgcttgaaataatctctattatcaattaatgtcatcctacagtgctgtattttactcatttagcacccgaacatctgaaacatgaaagcttacaaaactgaaatttaaaagtaattttaatatttgtatcacatgtggcaaagaaagggtcattattcataatacacaatgagatcatttaaattagtactaaaaccatgaaaatttagtaattaattcaatgaacaatatgaacaaatgtgttcacataagggaaaaacatccaaattgtaaacagtttggtataaaatataattattgatactaacctgatgtatgcaagttaactttgaaaaaattattttcactaatttagcaatttgtaaagataatgttaaatagaattgtaattcacttattggtagaagcagtctttgtctcaaagactattaaaatgcccataacttttggtcttgtaaccccactcaatgggctttcttctaagaaaataattcaacagaaagaaacagctacctgcattatgttcatttcagtgttatttataacagcaaatctggatatgtataaatatatgcaattaaagacatggtataacaatttatagtacatcaacttgatgaatagaaagtaataactatgttaattttaagaccatatataaaacatgaaacagttttttatgattcaagtacataatccaggaagaaagttcagatacaaaaagatttagaattatggatatgccttcccaaaaaaatgtttttacacattgtatgatattttaaataatactatttaattatcatatttgtatatttgatttgtatagaaaatcagaagagatgttatagttgcttttcttaaattatcaaccaatcctaaatctcataacttttatttgatcatttagaggcactcataaatcttagttactataaaatatttcattttagtggactgctcagttctggggttaataagtcaataatatccaatttaagtccctttttaattttcagtgttagttatttactggtaaacatggattcatatgctcatgttgattagtgcacacacacacacacacacacacatgcacacatataaaggagctcatttttataactagtagaaaaatcctaatctccaaacttggaaaagagttttaaaactcaccttattgatttctctttgcagctaattttacacatatattgtcttgaatcctcactgtcaatatattctccctcatatctgataggtgacaagtcacattctttaacaaacctttggaggttgtcaccatggtcggagctggggtcctatgagaattgttttttcatcatccctatgccttttgcattgtatctctctgttcacatcaacatttgtcactgttctctgcctttcatatcggacacattcagcttaatgataaattaaaacttaatagagaagggtaaaaagtaatattagaccacaaggtatcctgtagaatctttgttctccaaaggctgtatagctatctgttcatatgcttatagaataaattgcacaatgtcagagtagacaatactactgttgcttcagtaacatgctcacagagtgcaagaatgtaagtcaaaagacaggtgaaactgaacttttgaaatatatcccaattgcttttaattgtacctctccaaaaatgtaaatatagttaaaagatttttttaaatttctgtgttaacatttgcatttatttaacaaactcagcatgctcttggagctgatctctgtgcttttcaaatatgaactcacttaattctcaaaatgacccatgagggtagtgttattatagtcattttatatgtgtgaaaactgagacacatggagaagttaaaaaatgtgcccaagatcccacagcttgtgagtgaaggtggacctcaaaccctggcagacaattcctggtcatgtgagaaaagaggacttctccttgcaacaccttgcagggttcgggggtaaactctgtcagatccataaagctatgaatctcctgttaggctgatgggatttaattgcagctccactattagaaagtaaaaataaaagtacaattatgtctaatagttaaaagattggcaaatagttaaaaatgtttcctttcactcttgaaaacatctctcaacagcctttctgatcattgttgtttattttttaaatggattatttcaacatttgtcaaatgctaaatatattggactctttttttttctcttttgcttgctagcgctttccagggtctagtaagaggaaagaaatcatgaccaacctctcctgtcccaaaagcctcccaggattacccttttaccagaaaatctatttttatataaaatagatggcttctgctcataccaaattttgagctgcttctaagtgctagatagaactattaaagatttagactgacttactcactatacaccatctctggtctctatattcagttccatgctcagaaaagtaaagcaacagtttatctaaagttccactcacccaaggaatcatttattggatcatcacaatattgagaggggtttatggttgtgggagaatttccatgccaaaaatattcaaagggctttggcagaaacatttgtgttcagaagccagggtacacctggtcagtcaaattgttggggcctggaactgtccatttagtgagctgtgattttaaatcacttcattctttgtatttgtgtctatgcagtatactctcttggtgaaatgtgtatacatttttgtcagacttactgaaatatgattcacataccatacaattcatcattttaaagtgtacaattcaatagctttcagtctactcacagatatgtgcaaccatcaccatggtcaattttaagacatatttatcaccttggaaagaaagcaccaccccttagctatcacaacctgtgcattcttctccccagctctaagaaactactaatctaatttctgtctctatagacttgcctctactggatatgtcatataaatgtggtctttcgtgtttggcttctttcacttagcacatatttttaaggttcacccatgtagcatgtatcagaacttccttttttatggctgaataatattctatcatacatttactcttaatatctctgcctgttacagatatatgtataatatttagcaaaattttctgaactaaaatttaaatttagttagccttcaccttcccactgataaattctgagaggaatttaggcaatccactgtatattttatctacataacgtcatatgttcatcttttggaaacatctgcgttacagatagcaactgacagctcttacacggatgcctggtcttatataaatccaatattatggttatctatcttttgtccacagcatctatgggttttaacaatttaaagcatgtgaacatttaaagcttatattcctcttataccataacactctccataacagtatgcatatgattagtattttttctatatgccaatcagttatcccaaccacaaattttatgccatcgctaaacaacagaattcagtctcttgagccctgatgctcatgattatcccagacagacatgtttgtgcatcttcataaattattactgccttactagtttcaaataatctccaaatattgattattaaatgcaaacatgagttatgacatttggtaaacttaaatattgtttcatcagagaaatgaaaaacttaattagaaatcgtatctagtacaaaagccattaacatagaaaatctgagatccgtttaataattaatcgagccaacatggtgacttagggcttatggaaatattagaggcaagaaagctaattttattggtgcattacttgggataatttaatgtcattcagagggtggcagatttttcacttttagccttaggttagagtaactattagattttaaaaagtagcttttcataataacgagagttcattcaaatagatttccatgtcacttgaaattaccaatttgtataaatttcattaataaaattttatatcactttttgtaatctttctaaatgaaaacaagctgtttcattcattcagcgaaacatattcagaagcccctactctgtaagagcactatgctgagagctcagagacgcaaggatggagatcaactaaacaaggttgaattgacgtggtccttcctgctgtaccttccagccggccgtcaaagtgccataacttaggacagaaaatgagagttctaaacttaatttctcagtgccatgagaactcatagaaagaagtagtgttcagaaaagttgtgatatttaacttccatctaaggcgttcactcttggatgggaagaagggaaaaggaattctatacagaaggaacagcattagcaaataaataaaaataagaagtcagaggaataatgagtgcagtgccctttggcttgagcaaagtgtttatgaacagaagtagtggcttaaagctggaaagaaaggttgaagataatgatgaaggggcttgaatgccaagtgaaggccttgggcctttgcagtaagtcaaataaggaactatgtttcagtttgtaaacaggtgacatatatggagtcctgaagtaaggaggctattctgaatggcatgtgcagggtggatcagatatgcagaaacaagtattaggatattcctagaaagcttggacccattctccccagagtgccctggaaatacctgtcgcagaaattcaacctcgaggaggacttcacagtgacataagtttgactggcatcatgttataccacttcttggagattcactatgtgaattaacacattaaaattcctgagaaactttgctgttaaaaaacaaaacaaaaaaaactcacggaaaacaaagtgagagactctgccagattaaaggagactgaggaaacacgacaactaaataaaacttgtgaccctagaccaaaaaacagacattaatgagacaactgttgaaagttgtataaggtctgtggattagataacagtattgtgtcaatgttaatttcctggtttttataatcatactgtggctgtataagatgctaacatttgaggaatatgggtgaaggatatacaaaaattcattgcattattttttcaaatttttggtaagtctgaaattacttcaaaattaaactttaaaaatatttttataattaaaagtataactgcatttccaatcaattatctaagataaacacttttggaaatactcccaggaaagacaggggaatttatatccacagagcagctgggagaaagagctgggttgacagagtaaatgagttcagagctgggttgacagagtaaatgagttcagatgtggacacatgatgaatcttggcaccattcttgcccttaacatattttaggtacatatacatgttttaaacctagttacctacttgagataatgaaatcccctctcttgctctttcagtcagaatggtccctattgcaatgactgactgggaaagggaaattagagacagaattatccaaataattcacaagaatcccaatatgaatttttgagaacatggtttatttcatatctccacattattcagaagtaaacaataaacttgggattcttcacttaatatatggtccctggagattctcaaatggttcctcaaaccctaacactctagtattatcagtaaagacatagttaatcacactcttttttctataacctgtaaaacaatgaaaacacaaagtaatcttttaaaaattacattctcttaaccataaaacaataaccacatcaaaattattgtctgaattttagttttttatataaatggatttttggtgaaaacttatttaatatgataccttactaatttaattacatagaaccttcatggatgggttgttctggagatctaaataaaggattagtcttgagtgtgaaaacttgctaaattttaacaatatttaatttagtaatggtagaaatcaattcaatgatttgtaatggtagaaatcaattcaattctccatttcttcatcaatggagtaataggattagaaatgtgcctaagtaagatgaattatgtagcagttgcagactatatttcagggaagatttagagtcagaacagtcctgcagataggtgggggcttataaagcctgagctagaatagcatgaagaatgtggaactagagagacttatcagacggacatcaaatcatgagaacatggtcattaattggataagacagcaatttaaagaaaaatcccaaagataatactcagattttgagcctaggtgacaagtgaaattgcagtaatgctgcagaaagagggaaataatgattagaaagtacataggcatgggcaaggacttcatgtctaaaacaccaaagcaatggcaacaaaagccaaaattgacaaatgggatctaattaaactaaagaggttctgcacagcaaaagaaactaccatcagagtgaacaggcaacctacaaaatgggagaaaatttttgcaatctactcatctgacacagggctgatacccagaatctacatagaactcaaacaaatttacaaatttacaagaaaaaaacaaacaaccccatcaacaagtgggtgaaggatatgaacagatacttctcaaaagaagacatttatgcagccaatagacacatgaaagaatgctcatcatcactggccatcagagaaatgcaaatcaaaaccacaatgagataccatctcatgccacttagaatggcgatcattaaaaagtcaggaaacaacagatgctggagatgatgtggagtaataggaacacttttacactgttggtgagactgtaaactagttcaaccattgtggaagtcagtgtggcgattcctcagggatctagaactagaaataccatttgacccagcaatcccattactgggtatatacccaaaggattataaatcatgctactataaagacacatgcacgtgtatgtttattgcagcactattcacaatagcaaagacttggaaccaactcaaatggccaacaatgatagactggattaagaaaatgtggcacatatacaccatggaataccatgcagccataaaatatgatgaattcatgtcctttgtagggacatggatgaagctggaaaccatcattctcagcaaactatcgcaaggacaaaaaaccaaacaccacatgttctcactcataggttggaattgaacaatgagaacacatggacacaggaaggggaacatcacacactggggcctgttgtggtgtggggggaggggggagggatagcattaggagatatacctaatgttaaatgacgagttaatgggtgcagcacaccaacatggcacatgtatacatatgtaacaaacctgcacattgtgcacatgtaccctaaaacttaaagtataatttaaaaaaaggcactgggaggtaaactttagtcatttcatttaatctatcacataattaaaaaatagtttaattttaatttaaggaagagagtcaaagaattattcctggcagtcaggaaccttaacaaatcctggggtacaggaagcctctgcacctgtcggcaaggtggggagttctctcaacgggtaacgtcaggtattgcttagcactttacatctactgcatcctacttttgcttacttttgatttaccttttctatttctcctagtaggtttgtcctagaaggattttttaaaattttttaatttttcttttctgtttttttaccaccttgccttggacataacaggctcacagtgtatactgcataattactagcatatgagacatttatgtataggtaagcaaaactaaatgaactaattgtagagagtcaaaagtcaggtggaggaaggaaaactgtgctgcaaagtaatgacagcatgtgttgtgtgctctgtaatttactttaaataatgttctgtgtatgcatactgggtttgctgcttatcctggggaggtgggggaggacgggggtggattggtcagttgtgctcagctcacacttagagtatgcgaatcagaagggtggttcacagctgaaggactctaaacaaaagcccacatgtcagagacagcttctaaaagcttttagcatccactccctgatcaacaccaagaagtgtttacttagtatattgagtatcagaaacgatgttatcttggtcagatgaatggatctcaagttaaatgaattgactggatgtattcttcaggcattcctagttgctttgccttcacagagcatctgaatgcagtgagcttctggccctatgctttgttcagataattgaggattccattgcctgactccagttggaagtatggctgcatcttctattagaatattgtcagaagcagctcttcatattgccgaaaagaacagacagctgggactttagcaagcttgcagaataggttttgtaactgcttttatgctgcttgctaataaatatcggtatgtgttaagacagagtttatattgagacttacttgatttctggtagctaggttgtgggagagaaacaatttggccctttacttcctctagatatctactccccccaaaaaagatgttatgattgtaaataatcaaattagtttagttaatatttatcagaatagcctaggcagacttctcttaggaagtagcattgctggacatggtagctcacgcctgtaatcccagcactttgggaggctgaggcgggtggatcacctgaggtcaggagttccagactagcctggccaacatggtgaaatcccgtctctactaaaaatataaaaattagccaggcatggtggtgggcacctgtaatcccagctacctgggaggctgaggcagaagaatagctggaacccaggaggtggaagttgcagtgagccaagataaggccagtgcagtccagcctgggcaacaagagcaaaactctgtctcaaaaaaaaaaaacaaaaaacaaaaagaaacatggcatttgagctgaaatgaactcatttgaatactggggctaagaatattccaagggaaacaaaaattcatatgggtagaacttagcaagtaaagaaaagagtgatggaagatgaaattagagaagtaagtagatgttaaagaagatgtgacacacaatttaagacattaggatggtgtcaccatattttaaccagaagaatggcatattctaaatttaggaaagcaactctggaactactcaagagaatggattggagagaacaaggctatcacagtagaccacatgacagaagatggtagattggctttggtggtagcagcagaaatagaaatgcctagacaacagttcttgcaggaaaagaggaagtggtatgttaggtaaaggaaaaaagaggatgaggcttaggttttggatctgagcaacaggatagatgatactgctgcttactgagatgacagagttgagagattttgctccactggtagcttgtatcttttttaaacttgaataaaaagtacagtacaaacacagactaaaaaaaaaattcaataattagagaaatctttctagatctatcaaacaacttatataggctgggcacagtggctcacacctgtaatcccagcacttcggaggccaaggcaggcagatcacgaggtcaggagatcgaggccatcctggctaatatggtgaaaccccatctctactaaaaatacaaaaactagccgggcatggtggcgggcgcctgtagtcccagctactcaggaggctaaggcaggagaatggcgtgaacccaggaggcggagcttgcagtgaaccgagatcgaggcactgaactccagcctgggcaacaagtgcgagactccgtctcaaaaaaaaaaaaaaaaaaaaaaaaaaaaaaaaaaaaaaaacttatatagtcagcctaaaaagaagtatcatctagaaacagaaagtatgccttctcagattggaaaacctggctactccagtggttcggaattgattgtcatttcataatggcttaaagcaattagtgtgtatcagcatttacctttgactaaaaataaaactgctaacaagaaagctacagggaagtggtattctttatttaaattgattaatgtaaacagctctttcatttaaaattgatttacataaattcaagaaaatatttgcaatacacaattattacttagtaacaaagataatcaggaagtcctgcagacaatgaaacgtgaacaattaaaatattcaggatacacaaagcttttaattaatgagctaaactaatccaaataagcagggaactgtgttgtaaggcttggctatcatggattttgaagtcaatgattacaagaagaagaatcacagctactgttaagagttaacgaaagaggaaagaaatatgaaaagcagctcaacagtcaaagacaggtttattttggagaataaacctgagaggggcttctggccgatttcagtcaggcacattctctcttacaggctaagagtatttaagggttcagggcaagaaaacttatcacaggcttggaatgtgtctgtgtgaaggagaagtttattgaggggttgtaatgtctctggtcagaggggaggttcgggctgacatctctctggttggggaggttatatcaggctggcatgtctctggttagggaggggtttaccttaggtttggaatgtttccagttggagatgtcatttgtggtttatgattatgccgaccttagccatttggctgatgccctttgggttggatttagatggtttttgatcaagaggaactttaaaatggcagtgcctgtccaagatggtgatgttcctgctctgtcagctaccctgtactgaacatattccatgtgcctggtatctttctttgaagtactattttgcagaatcttcttgagaataatgtgaggtaggctttattatttctatatatgaagaaactgggacataaagaaaataagtattttgttcaaggtcctgtggccagtgttggggagagggcattaatcttggttctgatgtatctcaacactgctgtacttactgaggttactttgttagtacatagaataaaaggtaatatacaaataagtatttttttttgagacagagccttgctctgttgcccaggctggagtgcagtggcatgattatagtcactccagccttgaactcctgggctcaagcaatcctcccaccttaccttcctaaatagctagaactacaagcgtgtgccaccatacctggctagtattttcattttttgtagatacaaggtctcaatatgttccccaggcttgaaataagtgcattttaaaatacatgcgttggaaagatattagagttataaagagtcaatttgcaaatttcgtctgcttgacaatgtcatacaggtcaaaatcctcaaatcatgagatttatgtgtcctacatgtactggacaaagaaaacaaattcttttcaagctattctcattaatggaattaactatcagaaggaaaatccaattatcagataattttttaggtggggctttggaagattattctgtgcttacatgtgaacatgaaattatgtcaggttctctaggcgtggtggctcacgcctgtagtcccagtgctttgggaggccaaggcgggcagatcacgaggtcaggagctcgagtccagtctggccaatatagtgaaacctcgtctgtactaaagataccaaacaaaattagctgtatgtggtggtgtgtgcctgtaatcccagctactcaggaggctgaggaagtagaatcgtgtgaacccgggaggcggaggttgcagtgagctgagatcatgccattgcactccagcctgggtgatggtgtgagactccatctcaaaaaaaaaaaaaaaaaaaagaaaagaaaagaaaagaaaagaaattatgtcagattcaggtactggatgaaaaacaaatacggaaatcagagcatgagtgtgcaaatcatagaaagatttcattctcttatttctagaaccccttctcaacctggctagtacttccttcagcccctctaactttcagattgatggaaaggacctgcctaagcagaattcacctgcccctaatctagaaaggtgctctttcttgagcagatgtggtaaattcagtttttatcttctttccttaccactgagtcagaatttatatttgtataggagctagggtataagaaaggatgagtcaacaataatccaatacctttttatataagaagttaattacattaccttggttaatcataaaatctgtcttgatgttgcagatgattctattagatttaattgaataaaagaaagctttaaatcatattcgagtaaatatgtaccaggtataaattgtcaatatataactataattctgtatgtgtgtatgcatatataattactataaatgaatttttttcatctattaaactcagtattttatattccacttcagtacaagactttctataagattagtattcatattcaattaatatttcattataattttaaaaatatactttaaaaatacaattaaaattttatcaaatcaagccagaatatttattgctgagttgttttgatgctactttgcaaattacttgaatctttcttgcttgctttatttccattatagtcatcaacatcaagtattgattgatttacctttggcctagcactaaaccgggtagattccgtatctcaatataacagatataaaacatgttgacacagtcctatgctgatgattattggttattagaataacacagaggaaaagagaaaaaattatctgacaactattagtggaggcatataatagattttatgattaatcaagtaacgtaataactactttattaactcatttgatgttcctagcaatgttattattagctccatttcacaaataagaaaactaaggcaagaaaatgctattcggcttgcctagaatcatacaccaagcaagtggcagaactgagatttgaaaccagtactctggctccaccaggtgtctgctaaacaccccctctgtattttgattctctgataaagattaacttcagaattggcttccaataagatataaaagacacttccaattttctttgaaatttatgggtgagagggttcctagttgctattttcctgagccagatgctgaaatgaagacttgagtgcagatcattgatgtaggaggtgatcccaggacacacaagtgagaaaggaaggagaaaacccaggaaagggtaggctattgagcaaaaaaaccttatccactatgagtgacagggctcaattccctggagattttcccctcaatttggagtgtgtactatatagctcagaaattcctcactgaggggcaaagaagctggagtatttacttgtccaccaaatcccatccctattttgttgagggctttctaagaacattaaacctatgacattccaggatgccctggtttgggcttgagcaggttcccttggggacagaataagcctcagccccaccccccgaccccggcgagcatcacagtagccagtatgtaggaaaactgtccattatagcttcaggttaacttgcagattggccatgagaatagggagcagggaatccagcaaggagtagtggacatctattgtctttgcctgccagtttccattcccctaactttttataatagtacctcaattcccttttagttagagagctacacacttaattctttccctccgcatggtgaaggtgggttctcattaggatggagctgaccccactatcctccaggctctggattggacatgagacacaggaattgtcagtcagcatatttcttgctttggatctaatagttggcttaggaatagtcatatgagataaactggtccctgcatttcaactcaatgactcttaactattggagaagataaattctcacctcccctccaaggctgctgaattaggagggcatacacctgaagaggctggtgaccacctcatggaaagcacctacaagagaggaaagcagggctgtaaaacagagagacacacgcagatacagacaggcagacagaggatccagttatgctcaacccagctctacccttggacttttcaattacatgagtcgataaactcttttttttttcttaaatcagtttgaggagagtttctcttaccagtattatttcttcaccaaaatgttttcagtgtctacatagtctcttaacttctgagtatttttcatttacttagaagcttaggattcttaattgaaatagacatttaaagtctgctagaccgatcttctcacaacgcaggaacatcatctacagctgtgctgtccaatgtgacagccaccagcctcatgttgctatagagagaaggcatgtggcaggtccaaatgagagtgctttaagtatagaatgcacactagatttggaaaacttggtacaaaaaagaagataaaatatcatacataattattctatattgattatatatcttaaaagtcttttggatatattgggttaaatagaatatattattaaaattaattttacctgtttctttaaatttattaatgtggctactagacaattcaaaatcatatatgcaactcacattatatttctattagacagtgctagtccctgacaaagggtgatgcagcctctgcttgaaaatgcagctaattaaccctctgggcaggcgcatccatcattggactgttctaagtgtaaaaacgattttgtgcctctacattcaaaatccatcactttggaacttccatctattggcactagttctgcctcttgtgtatcacagagtatctactcttcatacatattcagctatttttacttcttactggaagattgccatccaacctgtctctcacagtcttatgaaacaggacatcacagacatttttgactcccgctctgctgacaggatacgctatttgcattgacaacagttgcaggtttggtagccataatctttctgtgcttaatgataaattaggcttcatcttcttgtgaagctacagacaaagtagagacttctgcttgaggctccagaagttctctctgccccaaaagtctaaatgagagaggtacaggagttaaggacatccatcagggatgtcattccttgctctgagttctatcacgggaaatgaatgtggactttgggatgagaaaagggcagttgtcaacaggaaatagcagctctgagttcattttcagcagacaacagtctgttccaacataacctactccaacctaagcttcatggagacagactggggctgacaaaaggtaaatggttttcatgtcactagtgtctttaaagaaataccaataaatttaatttccttcttaaatttaacaatccaaacaagtaaggtggaatgcagcagactgttatttaagtatgtcatgaagatttcaagttttagatcttgatgcctattttcatgattaaacaaaattaaaatctttcaagaaaaaaagttatggttccaaagactgttgtctgtgattatgatatattcaaagtattttcattgcaatgttgtggacatccatgataaattatgccttcttaattgggattatttttatttcaggcaattggcactcttgaaaataaaaacccatctgtccaaaaccattttttcatttcctgtcatttcagcttagattgcaccactaatctctgaaatccacattctagtctagtgatcaaacaaaagttttttctgatctatggaaaactttttattgcaaagaaagttcttaatgaaaaagttaaataagacaagttcaaaagtttatacaaggcactagttagagcatctaggatttgtggataaaataatatgccccaattatccggatgtgtaatttaggaagtaataaattgtatgctgatgaatctaattcaaaatatcaatacatgctaaggtactctacagcctgttcaaacaccctccccaattgtcttgtttcaattactatcaacagccacaaattggagttctgtctatatgatgccccaaacatttggttaattcagttcattcaacctagttaattcaatatgcaaaaaaattcaccaatgaattgacaagctaatgttctcaaaattgttgatcagtgagttgtaacctaagaagatttggctaagacagtctgaaaagccagggctctcctcccatctcactattccttcaacaactcattttgcttattccttccacttacaataaacttcagcatcttatagtgcctcttttaccctaattcaataagccttctctatcattaaacccaaagtttctaaagtcttatctctagaccattcctggacaattaaaagagtataggtgattcttctaagcagtttggagattcaacagtcctctctgaaaagcttcctaatttatgacttttttatcttctatcctagaatatgtagacactgtgggccccaattaactttctctattggtggatggaacctaagataactcaataatctccccttatagtactcatgcccttgcataatcctctcctcttgagtgtgagtagcatctgggatttgcttctaactaatagaatatgacaaagatgacatgtccatcccacgatttattatattatatggcaaaagtgctaggatgttattcccatgattattttacattacacaagactaggaggagcctgcacatctagcagaagagaaactaaggggcccaagctctccaaacatccctggctcattgggtgactgcatgcctaggcaagaaagatctggagagcacagaagatccagggataatctacaaattgcctgagtttttagtgtactccataacccccacacaggtgcaatagcagaggataggagatttactggctttaggtgtgtcttagtcagttcaggctgctataatagaatactacagactgagtagtttaaacaacaaacctgtgtttctcacagttctagatgctaggaaatctaagatcaaggtaccagcagatccagtgtctcatgggggcctacttcctaaattgcagatgattggcttcttattctatcatcacatggtagagacagacagaaaccaatccctcatgtctcttcttatgagggtactaataacatttataagggatccactgataccatcacattggcggttaggattttaacatataaatttggggggaacacaaacatgcagtccatagcaaggtgtttgagcaaacctctaaccagtcattgactgaccactaagttatgcagacttataggtgacctctaacagcccaggataaaaaataaaataaaaataaaagcagaattaaaaaaaaaaaactaagcagagacttcagcgaccagaagccaagattaaacctagaaaattattttaacacaaaacaaagcaaacgagtaacaactgacaggaggctggtgggcggggggtggagggaatgcagaatccagagttgagatatattatctaaaatattcagttttcaacgacaacaaaaaatgagacatgcaaagaaacaagaaagtgtgactcaaactccaaggggagaaaaaattaataaatagatatttgtctctaattggtattgtacattttatcagacaaagacttcaaagtattaattatcaaaatgtccaaaattttaaaaatcatgtttaaataataaaagtggtctggcacagtggctcgcacctgtaatcccagcactttgggaggccaaggtgggaggatcgcttgagcccgggagttcaagaccaaacagggcaagatagcaagatcccatctccacaaaaaataaatgaataaatacataattaaaggaaaatatcccaacaatgactcaacaatagaaaatctcaataaagaaagagatttttaaatggatattttataattgaaaattacaataaattgaaatgaaaagttcactaagcagtttcaataatagatttgaaatggcagaagcattaaacttgagaaacagaaattattcaatttgatgaaaaaataataataattaaagaacaaataaaagaacctcagagatctggggaaaatatggaacataacaatataaatgtacttggggtgtcagaaagagagatgagagagtaagtagcaaaaataatgtttttgaagaatgaatggcccatagcttatcacatgtataaaaaaaaagatctatagattcaagaaacttgacaaacctcaggtaggataaacacaaggagagtcacacttcaattcactatagttaaaatgctgaaaatcaaggagaaattcttttttattttttatttttatgggaacatagtagatatacatatttattgggtatgggagatactttgatacaggcatacaatgcataataatcacatcagaataattgggatatccatcacctcatatatttatcctttctttgtgttacaaacaatccagctttatcattttggttattttaaaatgtagagtaaattattgtttactttaggcactgtgttgtgctatcaaatactagattttatttatcctatctaactatatttttgtactccttaaccatccctactaccccccactattcttcccaccctctggttacaattattctactttctctctctccataaattcaattgttttaaattttactacctgcaaataagtgagaatgtgcaaagtttgtcttcctgtgcctggcttgtttcacttaacatgatgatttcaggttccatctatgttgttgcaaatgacaggatctcactttttatagctgaatagtacaccattgtgtatgtataccacattttctttatccattcatctgttgatagacactttgttgctcccacatcttggctgttgtgattagagctacagtaaacatgggagtgtagatatcttttgacagttttttgagaaacgtccaaagtcttctccacagtagttgtactgatttacattctcaccaaaaagtgtataaggattcccttttcttcacattcttgccagcatttattgcctttcttttggataaaactattttaactggggagaaatatcccattgtagttttgatttgcatttctctgacgttcagtgatgttgagcatctctttatatgtctgtttgctattcgtaagtcttcctttgagaaatgtctgttcatatcttttgcctacttttttttttttttttgagatggagtcttactccatcatcaggctggagtgcagtggcacgatctcagctcactgcaacctccacctgccaggttcaagcgattcttttgcctcagtctcccaagtagctgggactacaaacgcacgctgccacgtccaactaatttttgtatttttagtagagacagggtctcaccatattggccaggttggtctcgaactcctgatctcatgatctacccacctcaccctcccaaagtgctgggattacaggtgtgagcaaccacgcccggctcttttgccctttttttattggattattagatttttttcatatatatttgtctgagctgcttgtttattctggttattaatctcctgtcagacatacagtttgccaatattttctccctttctgaggattgtctctttgtttattgtttcctttactgtgcagagctttgcccagtctaatgtcttggagagtttccccaatgttttcttttggtagcttgatgatttgagatcttatacttgagttttttaattcactttgatctgatgtttgtatatggagagagattggagtatggtttcatttatctgtgtatgcgtttctggttttcccagcaccatttattgaagaatctgtcctttccccaatttatgttcttggcacttttgccaaaaatgagttcactgtagatgtatagatttaatcctgggttctctattccgttccattgatctatgtatctgtttttatgccagtaccatgttgttttggttactgtagctctgcagcataatttgaaatcaggtagtgttatttttcctcaggatagctgataaggtttggctatgtccctgcccaaatctcatctcgaattgtaatgccataattcccaagtgcagtgggagggacctggtgggacataattgcatcatgggggcagatctttcctgtgctgttctcatgatagtgaataagtctcacgagatctagtagttttataaaggggagttctcctgcacacgctctcttgcctgccaccatataagacatgcctttgctcctcactcaccttccaccatgattgtgaggcctccccagctatgtggaactgtgagtcaattaaacttcttgcctttataaattacctagtctaggatatgcctttattagcagtgtgagaatgaactaacacaatagcattgtctattctgggtcttttgtggttcaatataaattttgcaattgtttcttctattgctctgaagaatgtcattggtattttgacagatattgtattgaatctgtagactgtttttggtaatatggacattttgacaatattgattcttccagcatatgaacataaaatatctttccatttttctgtgtcttaaattttatgcatcagtgtttcatagttttcattgtagacctctttgatttctttggttaagttaatttctgcatattttgctttatttgtaggtattgtaaatgagattactttcttggtttctttttcagattgtttgctgttggcatatagaattgctactgatttttgtatgttgattttgtatcctgcaactttactgaatttgtttatcagttctaaaagttttcttgtggagtctttaggtgttaccaaatataagattatattatctgcagacaaggatcacttaacttattcctttccaatttggatgccctttatttctttctcttgtctgattgctctagctgggacttgcattactatgttgaattacagtggtgaaagtgagcatccttgtcatgttccagattttagaggaaaagctttcaatttttgcccatttagtgtgagactagctgtatgtgtgtcaaatatgacttttcttgtgttgtgatatgttccttctttactcagtttttttagggtttgtatcacaaaggatgttgaattttatagaatgctttctcagcataaattgaactgatcacatggtttttgtactttattctgttgacatggtgtattacattgtttgatttgcatatgatgaattatccttgcatccctggataaatccaacttggttatgatgagagatctttaaatttattgttcaattcagtttgctagtattttgttgaggatttttgtatcaattctcatcagggatattggtttatagttttcttttattgatatgtttttgcctggttttagtatcagggtaaaactggcctcatggaatgaatttggaagtatttcctcctcctgtattgttcagaatagtttggatgtgattggtatttgttcttctttaaatggttggtaaaattcagcagtgaagctatcacgtcccaagcttttctttgctgggaggcttcttattatggcattaatctaggtacttgttattgggctgttgtgaatttgggtttcttcatggttcaatcttgggaggttgtatgtgtccaggaatttatctaattcttctaaactttccaatttattgtcatataattgttcacagtggcctctaataatcctttgaatttctgtagtatcagttataatgtccccttcttcatctctaattttatttatttgggtcttcgttcatttttttcttcatttaccttgctaaaaatgtgttgattttgtttatcttttcaaaaaacaaaattttcattttgttgatagtctatattgttttattcatttcaatttcatttatttctactcagctatttattatttcttttcttctactagtttttcacttgcaatgctcttgctttcctagtttttcaagatgtcattatattatttatttgaagtttttctacatgtttcatgtaggcacttacattataaactgtcctcttagtactgctattgctgtattccataggtttttgcaggtcatgttcctacaataatttgattcaagaatttaaattttttttaattttctttattgacccactggtcattcaggagcctgtcattaaatttccatgtgcttctatagtttcccaaattcctcttgttattgatttctagttttttctagtatccattgtatattctgcagccattggatgaagtgttctgcaaatatctattaggcccatttgatctattgtacagtttaagtctgatgtttctttgttgattttctatctggataatctgtccaatgctgaaagtggggtgtttaattatccagctattattgttttggatctacctctctctagctcaaataatatttatttatctgggtacacatatatttacaacttttatatccacctgctgaattgacctctttatcattatataatgatcttcttcatctctttttgtagtttttgtcttgaaacttatttgcctgatataaatatgcctactcctgctttttgtttccatttgcatgaaatacttttctcatcactttgctttcagtctatgtgtgcctttataggtgaagtgtgtttcttctaggggtcttatttgttgggtcttcttttcctttcttttttctatatcaattcagccaccatatgtcttttgtttggataatttagtctatttacactcaatgttattatggataagtaaggactttcttctgcaatattttaatttattttctgagggtttttttgtgaccttctctttcttcttccttcctatcttctgtttagtgaaggtgattttcttcagtggtatgtcttaatttctggcttagtttgtgtgcatttctattgtatgttttctgatttgaagttacaatgaggcttgcaaataatatcttatagcccattattttaaactgatggccacttaatactgattgcattaaagaaaaccaaataaactaacaaggaaagagaaaaccaataacagctgtatactttaagttcttgcccctgcttttaaagtttttatagtttctatttataccttattgtataccctatgtcttgaaaagttgttgtacttattatttttgatcagttcatcttttaatctttctactcaagttgtgagtagtttatacaccatgattatggtattataatgttctgtgtttttctgtgtacttattattaccagtgagatttgtaccttcagatgattacttctcactcattaatgacattttctttcaaattaaacaactccctgtagcatttcttgtcaaaaaagtctggtgttaatgaagtttttcagcttttgtctgagaaagtctttatttctccttcatgtttaaagaatattttcactggatatactcttctatggtgaaagctttttccttcaacactttaaatatgtcatgccgctctcatgctctccagggttgccactgacaagtctgctgccaggcacactggagcttcatttcatgttatttgttttcttttgctgcttttagaaactttctttatcctcgacttttgggagtttgattattgaatagtttgaggagccttctttaggttaaatcaacttgttgttctataattttcctgtacttgaatattgatatctttctctaggtttggacgttctttgatattatccctttgaataaactttttaaccctatctctctgtctacctccactttacaggtaataagtctcagatttgctcctttgaggatttttttttatcttgtagatgtgcttcattcttttttatttttttctctttggtatcctatgactatgtgttttcaaatggcctgtctagctcactaattctttcttctgctttatcaattctgcaagtaagagagtctgatgcattcatccatatgccagacattttcaacttcataactactgcttgattattcttaagtatttcagtctctttgttaaatttatctgacatgattcttaattttttgtttgttataatgatttaattgaaattccaccaaaaagctactttgaattctctatctgaaaggttacatacgtctgtctctccatgattggttcctggtgccttatttagtctgtttggtaaggtcataatttccttgatagccttgatacttgtggacgttcatcagtgtctgggcatagaaaaattaggaagttattgtagtcttcatagtttgggcttgtttgtacacctccttcttggaaacactttccaggtattcaaaggtccttgattgttgagatctaagtttttggcttctgcagctgtgtcagcattaggagacattccaagccccatattgtagcacttgaagacttgtagaggtagcatgttggggggcttggataagacccagaaaaattctctagattatcaggcagaaactcttattctcttcccttactttcccccagacagagtctctgtatatgctgagctgcctggagctgggggaggagtaacacaagcatccctgtggccattaccacggagactgtgctggatcaaacctgaagccaatacagcactgagtctctcccacagcccatggtaaccacatcctggctactgcctaagttctcttaaggcactagacccttaaaatcagcaagtgggaaaaccagccaggtttatgtccttccctttaaggcagtgagttcctgcagtccaaggtaggtttagagatgctgtctgagaaccaggtcttggaatcagaaacttaaggaatctaccagatactgtatgctacggcagctgagctggcactgaagccacagaacaaagttcttaccattcttctctcccctttccgcaagcagaggagtgtggaactcttcccacagtcaccactaccacaggttcacaacaaatattgtctggctactgccaatgttcactcaaaacacaagcactcctaagtcaccttgtagtgaatactgccaggcctgggactctcccttcagggaagtgggctctcctctggcccagaacaggaccagaaatgctttgagagggcgagagactggaatcaaagaccccaagtacccactttttgctttattccactgtggccgagctggtatctaagctaccagaaaaagtcccctttactcttccctctcttttctcaagcagaaagagtccctcctcatagctaccatagctgggaatgtgctgggtcacacctgaagccagaatatctttgagtctcacctaggctcacagtgggtactgcctgggtattcctgctgattattccaggcccaaaggctcttcagttagcaggccatgaatcttgccaggacttgatccttcccttcaaggccacaggtttctttttggcccagtgtgtccagagatgtcatgtgggagctagggcctggaatgggggcctcaggactctgccaggtgccctatcctactgtggctgagctggtatccatgttgcaagagaacctcctctttactcttccctctcctctcaagcagagggaaggaatctcttacaaagctgtgatctgtactagctggtgttggtggggaggggtgacacaagctctttcttgactgatgtagctggcatctcactaggtcacatgctccccaagttcactggcaccaaagtccacacagcactaaagcttgcccaggagcgcagtccttatgcttagcctgcttcttgcatttacttaggaccctagagcactcacccttcaatggcaaggcttgccagaacctaagttctgaccactggcatggatgattctcctctgactagggctgttataaatgctccctacatggtgtcagctgagttttttccagtgttgctttccactgagacagcacagaactgtgttccaacacaaagtctcacaatcactgtgctctccctgtcccaatcccacatattctctctctgtggcaagaaagccaaaaaaaattgaatttacactgcatgttagaccaaatagacctaacagacatttacagaatattttgtgcaacattgtcagaatatacatctttctcatcagcatacagaacattctccaagatggacaatatgttagaacacaaaacaagtatcaacaaatttataaagttcaaaattataccaagtatcttctcataccacaatggaacaaaactagaaatcaaaacagtggtaaaagggaaatttatagtaataaacaactacatcaaaagaaaatcttagaaaaaattcaaacgaccaaataatgcacctcaagaacctaggaaaaaaagaacaaacaaaaccccaaattgacagagaaaagaaataataaagatcaaagcagaactaaatgcaatggagactacagaaacaatacaaaagatcattgaaacaaaaagttggttcctagaaaagataaacaaaattgataaactgctaccctacaaaacaagagggaagacccaaataaacaaaatcagaattgaggagatattacaactgacaccagagaaatataaatgatcatcagagactattatgaaccattataagctaacaaactggaaaaccctgaggaaatggatatattcctaaaaatatacaacctactgagattgacccaagaagaagtagaaaacctgaacagttaaatagtgagtaatgagattaaatcagcaataaaatgtctcccaacaaagaaaagtccaggaacagacagatttatcaatgaattacaccaaatgtataaagaactaataccaattccctcaaactatcctaaaaattaaagaggagggaattctccctaactcattctacaatgatagcatcatcctaataccaaacccagacaaggacacagcaaagaaagaaaactacaggcctatatcactgatgaacatagatgccaaagttctcagcaaaatactagcaaaccgaatccaacagcatatcaaaaaaataatataccatgatcaagtgggatttattccagggatgaagaaatggttcaaaatatgaaaatcagtaattgtgatatatcacatagacagaattaaagacaaaagtcatatgataattttattagatgcagaaaaagcatttgataaaattcaataccctttcatgaataaaaactctcaactaaaagttaggcatagaagaaacatatctcaaaataatagtggtcatatacgacaaacccatagctaatatactgaatggaaaaaagtcaaaagctcatcttctaagaactgtaacaagacaaagatgcccattttcaccactcttattcaacatagtatagaacctccttagcatagcaataagacaagagaaagaaagaaaaggcctccaaattggaaaagaagtcaaattgtccctctttgcaaataacctcattttatatttagaaaaaccaagatttcaccaaaaactcttagaacttacaaacaaattcagtgaagttgcaggatacaaaattaacataaaaatcagtagcatttatatatgcaaatattgaaatagccaaaaagaaatcaagaaggcaattccatttaaaatagctgcaaaaaataaataaaatatatatgaataaatttaatcaaggatgtgaaatatatctacaagaaaaactataaaacactgatgaaagaaatgaggagggcacaaaaaaatggaaggacattttatgcttgtgggttggaagaatttatatcattaatcataccacccaaaggactctacagattcgatgcaatctttatcaaattgacaatttcatttttcacaagaatagaaaaaaaaaatcttaaaatgtgtatggaataaaaaatgagccagaatattcaaagcaatcctgaactaaaagaacaaagctggtggcatcacattatctgacttcagaacatattatgaagctatactaaccaaagcagcatagtattagaataaaaatagatgcatggaccaatggaacagaatagagaacccagaaataaatccaaatatttgcagccaactgatatttcataaagcctccaagaacatacactgggtaaaataaaccgtcttcaaaaaaaaagaaactagatagccatatgcagaagaatgaaactggatccctatctctcaccatatacaaaagtcaactcaagatggattaaagattttaaggtaagatggattaaagattttaaagtaagacccaaaactataaaaccattagaagaacacatagaaaaaactctttgaaacattgctctaggcaaaaattttatggctatgacctcagaagcacaggcaatgaaatccaaaataaacaaatgggatatttaactaaaaatctgcacagcaaaataagcaattaattgagtgaaaagacaacctcttgaatggagaaaacacttgcaaactacttattcaacagggtattaatatccagaatatacaagaactcaacaggaaaaaattctcattaaaaaatggaaaaaagacatgaatagacatttcttaaaagaagatatgcaaatggccaacagtgtatgaaaagatactcgacatcactaatcatcagagaaatgcaaaaaaaaactacaatgatatatcatctcactccagttagaatgccaattactaaaaagacaaaaataacaggtgctggcaagcatgctgagaaaagggaatgcttatatgctgttggagggaatgtaaataagtaaaaccactatggaaagcagtatgtagatttcttaaaaaaactaaaaatttaattaccatacaatccagcaatctcactactgggtatttatccaaaggaaaagaaatcagtacatcaaagggacacctgcactcacatgtctatctcagcactattcacaatagcaaagatttggaattaacctaggtgtccatcaatggatgaatggataaagaaaatgtggcacatatacataatgggaatactatctggtcataaaatagaataaagtcatgtcattcactacaacgtggatggaattggaggtcattaatttaagtgaaataagcaaggcatggaaaggcaaatactacatgttcttactcatatgtgagagctaaaaataaataaataaataacttggtcacatggacacagagaatagaatgatacatacgagataatggatagagtgggtgaatagaagaagggaaaaatgaaaagaagttggctaatgggtacaaaatgcagttagatagaagaaaaagttctaatgtttgttagcagactaaggtgactgtacatagtaacaatattgtgtgtatttcaaaataattagaaaagaggacttgaaatgatatcaaaacatagaaatgatactcaaggtgatagataccccaaatgctgacttgatcattaaacattctatgcatgtcatgaaatgtgcatttttgtaccccacaaaaacattatgtattaataaaagataaaataaaataaaactttttaagtttacagacatgcacaaaaataattgataacagagtgctaaggactgaaagcttttgtccccccaaaattcatacattaacatcctaatcccaaagatgatagtataaacagtggggtttttagtaagggattaagtcatgagggctttgaatggaattaatgcccttataaaagagcccccagaagccagatagccctttctaccatgtgaagtcactgcaagaaatcagcagtctgcagcctggaagaagatcctcagcagaatccaaccatgctggcactctgattttagactttccagactccagagctgtgagaaataaatctctgttgcctataagtcacccagtctatggtatttggttatagcaggtggagcagaatgagacacagagaattagcaaggatataaaagacctccacaacactagcaaccaagttgacctgactgatactctgtaaaacgttccacttaacagcagaaacagcagaatacacttttttttttttttttttttgagacagggtcttgctgtggcacccaggctgctggaatgcaatggcaagatctctgctcactgcagcctcaacctcctgggctcaagcaatcctctggcctcagcctctagagtaggtgagactacaagggagactccagccatgtgccaccacatgcagctaaattttttatttttttgtggagacctgtattttgttttttgtttgtttgtttcaccatgttgcccaggctgttctcaaactcctgagctcaagtgatccacattcttcagcctcccaaagtgctgggattgcaggcatgtgccaccgtgtctggcccagaatacacattttttaaagagcacatgcagcattttccaggacagaccaaatgacaggctgtaaaacaagtctcaataaattttaaaggattaaattatttaagtgtgttctctgaccataagaacattgaatagaacggaaactaaaacataacgtatcaaaatgtacaagacacagctaacacagttatgagaggtaaattgacagttataaatggacatattagaaatgaaaaaggttttcaaacaatttgtctagatgttcacttcaagtaactagaagaagtgcaaactatccctaaagcaagcagaagtaaagaaataataaagagtaaagcaaaaactaataaaataaaaatagaaaaacaacaggaaaaaatcagtacaaccaaaggttgctactttcaaaagaccaacaaaactgataaagctttagctagactgactaagagaaaaatgaaagaaggcataaatcatgaaaatcagaaatgaaagaagggacataattattgaccatacagaaattttaaaagattataagataatactatgagcaactgtatgccaataatttagacaaactaccaaaaaatggacaaattaccaaaactgactcaagcagaagtataaattttgaatgtactgaaaaagagaaaataaataaattagtaactaaaaatcacccaacaacaacaacaaaaatatcctaagccctgatagcttcactggtgaattctatcgaatatttttataccaattcttcacaaattccttcagaaaatagagcatgaaggagcacttcccagcttctgttgggctggtattacttagacaccaaggccacaaaaagacgtcacaaaaataaaaaacatagatatatgaatcttttttcagacattgacaatccaaaatccagcaacatatgaaaagttttattttcaaatgaaaactacagtgaaatagtcacttcacacccactaattgggctatgatttaaaaagacagacagttacaaatgtgggtgaagatgtagagaaattaaaaccttcatccactgctggttcgaaatgtaggatgatgcagctgctttggaaaacagtctgacagtttctcaacaaattaaatacagaacttctgtgtaaaccagcaatttcccttctaagtatatacccaagaaaaatgaagacataaatccacacaaaaatttgtacacaaatgttcacagcaactttactcataacagccaaaccataattataactcattaattttcatacaatgaaatgttattcagcaataaaagtaaatgaatcactagtatacactgcaatgtagataaccctcaaaacattataagttaaagaaaccattcacagaagaccacatggtatatgataccatttatatgtaatgctgtaataggcaaatctatagagacagaaagtagatcagtcgtcacttacactggggatggggtggtgaggaggaggagagatggagagtgactgttaatgggcattgggtttctttttgcaattatgtgaatgttctaaaattagattgtggtgatagttgcacagctccgtggatatactaaaaatcactgaattgtgcactttaaatgggtgaattgtatgctatgtgaatatatcataataaaactggttttaaaaagttttatatactatgacctaggggaattcattccaggaatgcaagattagcgaacatccagaaatacagtctttctctgactttttatgttaaaaataatactgcaatgaatagacatattgtcatcttttcagagggttgttaaaagacaatacatcactcctctattttctttttcagtttaaaattaagctggaaaatgacacaggaaatggataaatggaaatcagaatatgatccttatttctcataaatccagttgaagagcatggctttagataggcaattaaagtgtctttcgaatccctgcctctcaaactgagcaccctcacaactggacagccaggtgttctccatggggccggtacggaaataagtgtcagagagcaaatcatgctttcaggcaagttggttctcccatccctacttccataccaccaccaccacacccccctccctgcaacaaaaagaaaaaagtgctcaattcaagtgctcccaacctcagcaaaggagttttagtccctacaaatgtacatataaaaaatggagatagatgatactcccataacaagtagtcttgcagagctacttacactagacatgtggaatcataattaaaccttcttatgaataaatatttgtggaataaataaatgactaaataacacatttaacagtatagtactgaattgtttttatcccatctggggtaatatttttattaagtgtctttcatttttatatattgcagggagggacagcttgaggataatcagtactttccagtaaaaccctgccccactcctgtactcctaagggattgccacctgctttcagagtggccaaattctgcttcacttctcatctcctcatataaaggattcatgttgaattacctagcaaagttgaaaaaaaacacctacagagggtccatcatgggtgatctagggaacagtaacagaagggcacaaaaaagaaaattggtcttgtaattgcattctgtcaaacagctagataagcagccagcagttttgcattagaatgcattcggttatcctatttacaatgggctagtaatcccataaatatttattgctgaactaaaaaaagcaacataagcttttaccctttgagaaaggtctgtaacatgcatggtgtcagtaaagtaggaaaccctgatgatttggttacttcttaatatgttagagtctggactgtgcttggcacatgtgaacagtttgaatgcagttgtcagtgcttgttcctggaggacaattgtaagcatatgtttcagtaggtgagctatcaaacccacagctgctctctaccctgaacctgaggcaggacaatgggaaacccaggcattggcagatttaactttgaatggttgagtacagggatcaatccgtttagagagcaacaaatgcaagaacagcaggagaaaaacagaaaaagaaaatacttttcttgagatgattctgtatctgtgtacattacataattttaatcattcattgtggcttgagggaaataactgatgctttccttgaaaggcatggcattcctcaagcaataaatatatttcatttccagttttatatgctgtatgtgtcaagtaaacaaatattaaaaacatatcgcttattgttttacaggtattttcatattctgtttactctccaaaagatttaggcagctagcaatagaagcacaaaaattgaaaagaccaaaaacagctattaataaaacaaagaaaatagtcaaaaataagagaaaggcagagaaaaagaacaaaacctcctgcccccaaaatctccaatagttagccatgatacttaattataaacttcctgtgtaaccaggacaaagaggaaaactcagttaataaatactatcatcctctttttttaaaattattattaatatactttaacttttagggtacatatgcacaacgtgcagatttgttacatatgtatacatgtgccatgttggtgtgctgcacccattaactcatcatttaacattaggtatatctcctaatgctatccctccccacttcccccaccccacaacagtccccggtgtgtgatgttccccttcctgtgtccatgtgttctcattgttcaattcccacctatgagtgagaacatgtggtgtttggttttttgtccttgtgatagtttgctgagaatgatggtttccagcttcatccatgtccctacaaaggatgggaactcatcattttttatggctgcctagtattccatggtgtatatgtgccacattttcttaatccagtctatcattgttggacatctggcttggttccaagtctttgctattgtgaatagtgccgcaataaacatacatgtgcatgtgtctttatagcagcatgatttataatcctttgggtatttgggtatacacccagtaatggggtggctgggtcaaatggtatttctagttctagatccctgaggaatcgccacaccgacttccacaaaggttgaactagtttacagtctcaccaacagtgtaaaagtgttcctatttctccacatcgtctccagcacctgttgtttcctgactttttaatgatcgccattctaactggtgtgagatggtatctcattatggttttgatttgcattcctctgatgggcagtgatgatgagcattttttcatgtgttttttggctgcataaatgtcttcttttgagaagtgtctgttcatatccttcgcccactttttgatggggttgtttttttcttgtaaatttgttggagttcattgtagattctggatattagccctttgtcagatgagtagattgcaaaaattttctcccattctgtaggttgcctgttcactctgatggtggtttcttttgctgtgcagaggccgtttagtttaattagattccgtttgtcaattttggcttttgttgccattgcttttggtgttttagacatgaagtccttgcccatgcctatgtcctgaatggtattgactaggttttcttctagggtttttatggttttaggtctaacatgtaagtctttaatccatcttgaattaatttttgtataaggtgtaaggaagggatccagtttcagctttctacatatggctagccagttttcccagcaccatttattaaatagggaatcttttccccattgcttgtttttgtcaggttggtcaaagatcagatagttgtagatatgcggcattatttctgagggctctgttctgttccattggtctatatctgttttggaaccagtaccgttctgttttggttactgtagtcttctagtatagtttgaagtcaggtagcatgatgcctccagctttgttcttttggcttaggattgacttggcaatgcgggctcttttttggttccatatgaactttaaagtagttttttccaattctgtgaagaaagtcattggtagcttgatggggatggcattgaatctctaaattaccttgggcagtatggccattttcacaatattgattcttcctacccatgagcatggaatgttcttccatttgtttgtatcctcttttatttccttgagcagtggtttgtagttctccttgaagaggtccttcacatcccttgtaagttggattgctaggtattttattctctttgaagcaattgtgaatgggagttccctcatgatttggctctctgtttgtctgttactggtgtataagaatgctcgtgatttttgcacatttattttgtatcctgaaactttgctgaagttgcttatcagcttaaggagattttgggctgagacaatggggttttctagatatacaatcacgtcatctgaaaacagggacaatttgacttcctcttttcctaattgaatgccctgtatttccttctcctgcctgattgccctggccagaagttccaacactatgttgaataggagtggtgagagaagaatcaaatagatgcaataaaaaatgacaaaggggatatcaccaccaatcccacagaaatacaagctaccatcagagaatactacaaacacctctacacaaataaactagaaaatttagaagaaatgaataaattcctggacacatacactctcccaagactaaaccaggaagaagttgaatctctgaataaaccaataacaggctctgaaattgaggcaacaattaatagcataccaatcaaaaaaagtccaaggccagatggattcacagccgaattctaccagaggtataaggaggaactggtaccatttcttctgaaactattccaatcaatagaaaaagagggaatcctccctaactcattttatgaggccagcatcatcctgataccaaagcctggcagagacacaataaaaaaagagaattttagaccaatatccttgatgaacattgatgcaaaaatcctcaataaaatactggcaagccaaatccagcaacgcagcaaaaagcttatccaccatgatcaagtgggcttcatccctgggatgcaaggctggttcaacatatgaaaatcaataaatttaatccagcatataaacagaaccaaagacaaaaaccacatgattatctcagtagatgcagaaaaggcctttgacaaaattcaacaaccttcatgctaaaaactctcaataaattaggtgttgatgggatgtatctcaaaataataagagctatctatgacaaacccacagccaatatcatactgaatgggcaaaaactggaagcattccctttgaaaactggcacaagacagggatgccctctcttatcatcctcttattttaaaaagttatgagaatttctcaaaactgcacatcaatacaaaatgtgtttttcttgctgtcttggtgtgatgctgaataccactaggcagtgagcaagaggctcttttccttgtgtgtgtgtgtgtgtgtctgtctgtctgtctgtgtgtgtgtgtgtgtgtgtctgtctgtgtgtacagcagaaattctaaaaggaaaataattattctctcttaaatatctgctgtatgtctagtacgtttccaggcactggggatacacagaaaacaaaacagatgtggtcttgccctcactgcacttaaaagctattgagaaagacatgctttgggcaagtaataacaactctgataagtgctactcacagtgatgggtgcataatcctcccatcacagataacagggagattcggcttagccctggtcagtagagcatttatctctgcctaggtgagtggtaggtttaaatatgctaaagtttaaatcctatctcggccgatgaccatccccatagcctcagccatgttgctcaccttctccgtagtaattgtattattgtgaggactaaataggtcttttctcatggcagtctcatgactaagagtatatcagcagaagcttcaaggtctctgagtccaagtcttaaaactcctcaaatctcacttctgctgcatcccactggtcaaagtaagtcacaaaggcaacctagattcaaaggatgagaatacagtttccacccgtttagaggaaatgcaaagtgccatggccattttggcaatcttccacatgacagtggagaatataaaatgaaccaacaagaacataaaatgaacagctcttagtgtatgactggacatggggaagtggaagaaaaaggaaaaaaggagccaatgatgacaccacattttctgtccagagcaaactatgtgggtatttttgcaaatcacttggtactgaattgagaaccagtgaaaatttaaccaacaattttagaatattttgttattatttggagtttttcaaaggtccaaataaatgactcaggctggtgtgagaatcataatcctcaatattattaaatattgttgaatttgttttgactttgatcctcaaaactgaaaacattcttcaatgtgtagaccaagacataaattgcttatactagttccattacaacaaattccacatatatcctgattgataccagttatgttgaagtgtttctaacactgtaaatgcctattcctcccatgtgagaattagcttattttaaggtgttttgactttcacttatataatgattgaaaacttccctgtgaaaaaactattatccatcttcataacagtttccagaaaaattaacagcactaccttaccaaaggacccagaagtaaacattattgaatatattttttgtttgtttttgtttctgtgctgattgttctgtctttcttggctttattgaggtacagttgacaaaaattgtatatattcaaggtgtacaacctgatgttttgatatgtatgcattgtgagataattacactatcaagttaattaaaatatttatcacctcacatagttccaggtatcactacctctttagttaaattcatgaccagggatactaatataaaaatttcaatagtctgagacctcttatcctcaaccctacccatgtaaatgaaactctggtggcttcaatgtgaatactcctaaatatctcttcctgtcttcctttctgcatctatgcagccactgccttaatttaagcttggaacagtacctgaataggtctcccttcctgtacctcccccttttaaagctattgtctgtatgtttctaaaatgtaaatccaattattaacttatcaacttaaaaaaagtgaatttctctatcagagagtccattccaaaccaatattttcaatggattacagaataaattagcagatttatttaacctattctcaaactttcaacaagagaaagcatacatttgcaaggaaattggactgttatttccaagccacactcttcattttcttggctataattcaagcagcatgttcaacattatttgggtggagacattgaaatggagagaagaataaaacatggtccttgttctcaaggaccccatagccctgtaggtaagacagaccttcaacaggtaatagtagctcagtgtgatacacactaacataaagttagaggaccaaggtatcaaggaaaagtggattgaggaagggatctggtgaaatgtgggaacatttcacagataagctgacacatgaataagtcttgaaagatgaatagaaatttataggttaaaaagccagggaataatattccagtgaagggggaacagcacagacaattttatgaagatgtaaaacaacatagtacattcaggtgagtgaaatgatttagtgtaatgatttaataggaaaagtggtggaagataaggaacaaaaaggtaggtgggtactaaacccatgaagggcttcctactctgtgcatgcccaaggtgatatacatagggtgcagtgttgggttgaaccataagagataatcctttatgttggtcaaaagagtcaactattggagtttcagagatgcaaaatactacaattcatctgtggagtcttaagccaccttcaactttggcatttagaagtgagtatgcctaacctgacacatccgcttgtgagaaaaagaagcccagtcaacgtttttcaggtagtgggtggttttaccaagggaaaaaaaaaagcactcccaaaagtccaagaacaagagttggactcagctgatggaaatgatccccaccctgccttccccatagcttgctggtttttttgtaaatttcatttttctttctccgtcaattgacattttttacttatagtttctgcttcctcatggctttatctcactatagacatggcaccccaagcccttctccaaatcaaaactttttggcttcagctttctcagcaactgagaacttacaaacctgttttgaaatcctgaaaggatgaatctcattggttcagctaatcttttttttactaggctgtgggttactggccagtttatgagctggttgtccctctttaagtccactacctatcagtagatccattacctgtgactgtgggaataacatggagacgtagtggtaggagggtggatgggaccacttccctcagaagtgattatggtgggcaggcctgttgaggctgagcagctctgcttatttctcccagtaaagttggcataaaagcctctgagttgattctcgaggtctaagaaaatctaatctccaacattgaagtttcagctctaagaacatctaagatatgcatcctaaatgtcattacccagaatgtctataatcttcatcaaacctgatatttctacattaattaattcctaacattactggaatttgagcccaaggttggggggaaatcactaataaagtcacaacagaaagatgccctgttttattaaccaaatgcatctgaccatataaacaattgttgacagtcatttcttttctacctactcacattggatgtgcttgaacatctgctttctgccctttaaaataaaaggcctctcttacaacatcagtggctattagaataggtgagctgcagtgctagcaatagctttgttcttcttcttatcactgcttttgccttctgtttgccaccattagtagcctttgcacataaagcctattaatttctctacagtaagtaaggtggcttgactagtaataagtggcatcaaaatgagctgatttttttaacatgtccagattctagtctggctccaataaatatcaaataaatcatgagacaaatgtcatagacaactcctttttcacttcctatgtcgtgtataagtacatgaaaaatccattcaacagtcactaatgaatgctattaatagataaaatgtcatcaggcaaaagcagagctcagtaacagtacttacaaaatagtcctggattctgaagcggctctctggaaaatctatacccacccccccaccaaatctacataaaatactgttcttacatatctattaaagtgtttcttgaggtgaggggctgggaagggaaaagtaagggtagcgagcaggagaaacggagatctgtttgagctcagcccttcttctagcctcatgttctttcctctccatctcctacacttgttacttatttattagggagagcattacaaataatgtcagacttcctggtagttgcctacagccctgtgatactgcgtataatttgtattccagcattgaagtgtctaacgtggtagaaatgaggagtagcttcctgacacacggactgtgagtgcagagatagtgaagggggtgtagctgaagagcacagcactagctgtctcttggctcctgctgcttcttttattgcctttcccccttctagcttgttcatgccaatatttatccatccatccatccatctatgatctttccatccccttcacacaacttattgtgtacctgtgtgtgtatatcatggtgccagtgaccacaatttgacttaagctcagcatatcaaaatctgtagagagcaaggtccaggaatttgtataattaatcaactctaaagatgattctgattctcagacctgtctgagtaccgcttatttagcagcttcaaatatgtttgacctggattgctaccaccaaggaggtccccctttgactttttcttatctgctgctaaaaccttatcctgattattttcttctcttacaaatgtaacacaaaaggaaaccaataactaatatgtctaaggtttttgccaacatttataattgaaataaatgctaaaattgagttagaggttagtgaaaagaaaaatgtacttttttccccaccatgttcatgggtcccctgaattccatccacaagccccttgggtgcctatggaccccaggttgagaagtactgtaaacaggaattttacagcagtgctgtgcagcacaaaaggcaccaacccatcctagaatcaagcagtcttaagtttagatcccagctccagaatttactcgctatagaacgttcagctagaaggtacttaacttctcaatgtcttcattttgtcttttgtctttttttttagctctaaaatggaattaaaagagaattagtaacaataatgtcttataagtttctaaatttaattagataacataggtagtatcttggaacattatgaatgttcaaaattaggttcagtatatattattcacctttccccatgttaatctaaattacctgaaggatccttaggcccagaaaatcattattgtatgaactcactttaactgtatcagctagtcatgttttcagttgaaattactatgtattaatcacattttcaaatatgtgtatgcatgtgtgtatgtatgaaatgaccctaactctgcaatttgtgaatctgtataaatccaccaaatatccagatcccaaccaagcctcaaaacctttcaaagaccctttttaaaagtgttgatttggccaaaaaaatgactgtcttcaattctccacctttagtttgaggcttaccaattaaatgtccctcctctgtgatgtgattttaaagtcagcagtaggccaggcagggtggctcacacctgtaatcccagcactttcggaggcagagacaggtggatcacttgaggccaagagttcgaaaccaaactggccaacagaatgaaaccccatctctactaaaaatacaaacaatagctgggcatggtggtgcatgcctgtaatcccagctactccagaggttgggacaggagaatcgcttgaacctgggaggtggaggttgcagtgagccgagatcacaccactgagctccagcctgagcaacaaagtgagactctgtctcaaaaaaaaaaaaaaaaaaaaaaaaaaaaagtcagcaatgaatgctagatactgcatccagtctctgcagatgctcaaggctgctcaatttgtctagatgattacactgcccaaatgcacacatgatgctcgacattcatctaattgcaggcagccaatctgaattcctcacatgtaggccattgatgactaaatgtatccagagatctggatttacagagaatattttctcataacaacacttaaatctcaaagaattgtttacacccagactctagtcttaacctatcttgtactgtgcagaggaacaagtatgtacaggatagtaagcactgtgtaatttaatttggtagaaaggggaagtgtgatttttatgctgaaagaatactagtttttgtatcacacatacacacacacacacacacacacacacaaatactcatgaacacacattgagcttaacaaaaatttcaaggcaccattctgaaatctgtccattagcacttcaagtgtgattttattcatacatgctggttctcctgaaaaaggtggactttatctcacaagtattttagactaacttaaagacagcatgaagtgctctctgattccatttgtttagagaacaatagcccctctgtgatataacaggaattggatgaaaatatcttctacctattgtttcttctgtatgtgacttgatctttattctctgtaaaaagcagaatttctttgtttccgagaaggatctctcctcaggaggattaaaactcttttcttacagctctttagcagaaatcactttcatagctaaacaagagcatagtaaatggattttttccagaccctaaaacttacataaatgggctctcttgttcacccaaaggtcaggaaaatgcagtctgcaaataacaaatggtagaaatccacataatagactccttggtcataggtgaatttagcagcaggcacttttggaaaatgtgtacacatgtaagttaaaagaatgattctaccaaaatcttgcagatgatgagcagttaaaataatgttgggaaaaaatgactcatcctttttatacttgagatgaacgatgcaaaatggagtgcccttccattgtttacctgtgtctcctgccagacagtgacctccctcagctcgcagggccttacttattttttctcatgtctggcagagagtctcatatatggtagactttcaataaatattagtggaaaatgatgaacacataaatgaattaaaaattgtaaccagcaatgtctaaacaaggtaaaaacaactataatgttatgggctaaattgtatgccccagaaactcatgctgaagtcctaaccctcagtgactcagaatgtgaccttatggaaaggagtctctgaagacaataattagttaagatacggtcacagtggagtagagtgagcccctaattccatgtgactattgttattataaaaaggggaaatttgtagaccgaccctcacacaaggagaatgccatgtgaagaatggagttatgctgccacaaattaatgaactgccagatgctagacatggaacagattcttcccaaagtgcttttcaaatatgaactcacttaattctcaaaatgacccatgagggtggtgttattgtagtcattttacaagtgtgaaaactgagacacatgaagaagttaaaaaatgtgcccaaggtcacacagcttgtgagtgaaggtggacctcaaatccaagcagacaattcctcatgatgtgagaaaagagaccttatcagttccttgcagcaccttgcagagtttgggggtaaactctatcagatctgtaaagctatgcatctcctgttgggttgccgatatttaattgcagctccactattagaaagtaaaaataggccaggcgtggtggctcatgcctgtaatcccagcactttgggaggctgaggtgggcggatcatgaggtcaggagatcgagaccatcctggctaacacggtgaaaccccatctctactgaaaatacaaaaaaattagctgggcttggtggtgggcaccagtagtcccagttaccctggaggctgaggcaggagaatggtgtgaacccaggaggcggagcttgcagtgagctgagattgcaccactgcactccagcctgggtgacagagtgagactccgtcccccccaaaaaaaaaacaacaaaagaaagtaaaaataaaagtagaattatgcctaatagttcaaagattggtgaatagttcaaaatgtttcttttcacccatgacccttttcaccttgatctcagacttctggcttgcagaactgagataataaattgttgttgtttaagccaatcagtttgtgggcattttgttttttacaacacatagccctagcacactaatacacatagcaattaagaatttggaagtaggaagagtaccaaaaatgttgaaaggaaaggagatatcaagaaaacattgctaccagaggcagtgtcctaaccactaattaggatggaagaactggactataatgcctttggaagaaataggcccctgacctggagtcaaggcagtaaccagatggggactcacaggaccaaggtgtccatcaaagggggttgaagatcaaatagcacatgagggcctgctttgaggttggaattagagctggttaaatgttttctttatcaagtttaaattgttgttgggactggaaatggaggggaattgtatgtggagatctagagaatatgaacatagtgaggagggatgcataaactaggaagcagtctgcccaaaataatttcatcatgtttggagcatatttcctacttaaagtaataatcagcagagttaacagacaacccacaaagtgtgagaaaatcttcataatctatacatctgacaaagtactaatatctacagtgtacaaagaactcaaacaaatcagcaagaaaaaaacaaacaattgcatcaaaaagtaggctaagggcatgaatagatcattctcaaaagaagatatacaaatagccaacaagcatacggaaaaatgctcaacatcactaattatcagggaaatgcaaatcaaaaccacaatgtgataccacctaactcctgcaagaatggacataatcaaaaaatcaaaaaatagtaaatgttgatgtggatacagtgaaaagggaagacttttacactgttggtgggaatgtaaactagtataaccacaatgaaaaacagtgtggagattccttaaagaactaaaagtaaatctaccatttgatccagcaatcccactactacttatctacccagagaaaagtaagtcattatataaaaaagatacttgcacatgcatgtttatagcaacacatttgtaattgcaaaactatggaatcagcccaaatgcccatcaatccaccaacgagtggatagagagaaaatgtggcatatatatagtatgcaatactagtcagccataaaaaggaacaaaataatggcatttgtagcaacctgggtggaattggaggctattattctaagtgaagtaactcaggaatggaaaaccaaatatcatatgttctcactcatgagttggagctaagatatgaggacgcaatgcataagaatgatacaatggaatttggggacttgggggaaagactgggaggtgggtgagggataaaagactataaattgggtacagtgtatactgtttgggtgatggatgcaccaaaatctcataaatcaccactaaagaacttattcatgtaaccaaacactacccgttccccaaaaaacctattgaaataaataataaataaacaaacaaataaataaataaaaagttaaattggccatactgcatatgcaatgggattataattttgtatatgccagtggttgattctgccaattattactcgtggaggggttcatgcaagaccctctgcaaagcattgtttgtgatacaaagtattctaggactctggagtaagaccaaagaccaagtctaccactctgccacttatctgctgtgatggaattcccttctagtactgaattttatgctatgacctcagatctatttctaaaaggaggaattcccagtacacagaactaaaatcatcatgtagatctgcagacatacagcctgcaccttccagggattttctctactataaattcactacggagaatttcggtaaagccatgtttttctttaaaaacaatatcagtggcagccaagatggccaaataggaagagctccggtctacagctcccagcgtgagtgacgcagaagacgggtgatttctgcatttccatctgaggtaccgggttcatctcactagggagtgccagacagtgggtgcaggtcagtaggtgcagtgcaccatgcgcaagctgaagcagggcgaggcattgcctcactcgggaagtgcaaggggtcagggagttccctttcctagtcaaagaaaggggtgacagacggcacctggaaaatcgggtcactcccaccctaatactgcgcttttccaacgggcttaaaaaacggtgcaccaagagattatatcctgcacctggctcggagggtcctacacccacggagtctcactgattgctagcacagcagtctgagatcaaactgcaaggcagcagcaaggctgggggaggggctcccaccattgcccaggcttgcttaggtaaacaaagaagccgggaagctccaactgggtggagcccaccacagctcaaggaggcctgcctgcctctgtaggctccacctctgggggcagggcacagaaaaacaaaaagacagcagtaacctctgcagacttacatgtccctgtctgacagctttgaagagagcagtggttctcccagcacgcagctggagatctgagaacgggcagactgcttcctcaagtgggtccctgacccctgacccccaagcagcctaactgggaggcaccccccgataggggcagactgacacctcacacagccaggtactcttctgagacaaaacttccagaggaatgatcagacagcagcattcgcagttcatgaaaacccgctgttctgcagccaccgctgctgatacccaggcaaacagggtctggagtggacctctagcaaactccaacagacctgcagctgagggtcctctctgttagaaggaaaactaacaaacagaaaggacatccacaccaaaaacccatctgtacatcaccatcatcaaagaccaaaagtagataaaaccacaaagatggggaaaaaacagagcagaaaaactgggaactctaaagagcagagcgcctctcctcctccaaaggaacgcagttcctcaccagcaatggaacaaagctggacggagaatgactttgacgagttgagagaagaaggcttcagacaatcaaactactccgagttacaggaggaaattcaaaccaaaggcaaagaagttaaaaactttgaaaaaaatttagacgaatgtataactagaataaccaatacagagaagtgcttaaaggagctgatggagctgaaagccaaggctcgagaactatgtgaagaatgtagaagcctcaggagctgatgtgatcaactggaagaaagggtatcagtgatggaagatgaaatgattgaaatgaagcgagaagggaagtttagagaaaaaagaataaaaggaaatgaacaaagcctccaagaaatatggaactatgtgaaaagaccaaatctacgtctgattggtgtacctgaaagtgacagggagaatggaaacaagttggaaaacacagtgcaggatattatccaggagaaattccccaatctagcaaggcaggccaacattcagattcaggaaatacagagaacgccacaaagatactcctcgagaagagcaactccaagacacgtagttgtcagattcaccaaagttgaaatgaaggaaaaaatgttaagggcagccagagagaaaggttgggttacccacaaagggaagcccgtcagactaacagtggatctcttggcagaaactctacaagccagaagagagtgggggccaatattcaacattcttatagaattttcaacccagaatttcatatccagccaaactaagcttcataagtgaaggagaaataaaatactttacagacaagcaaatgtggagagattttgtcaccaccaggcctgccctaaaagagctcctgaaagaagcactaaacatggaaaggaacaaccggtaccagccactgcaaaatcatgccaaattgtaaagaccatcgaggctaggaagaaattgcatcaattaatgagcaaaataaccagctaacatcataatgacaggatcaaattcacacataacaatattaactttaaatgtaaatggacttaatgctccatttaaaagacacacactggcaaactggataaagagtcaagacccatcagtgtgctgtattcaggaaacccatctcacgtgcagagacacacataggctcaaaataaaagtatggaggaagatctaccaagtaaatggaaaacaaaaaaaggcaggggttgcaatcctagtctctgataaaacagactttaaaccaacaagatcaaaagagacaaagaaggccattatataatggtaaagggatcaattcaacaagaagagctaactatcctaaatatatatgcacccaatatgagagcacccagattcataaagcaagtcctgagtgacctacaaagagacttagactcccacacaataataatgggagactttaacaccccactgtcaacattagacagatcaatgagacagaaagttagcaaggatacccaggaattgaacccagctctgcaccaaggggacctaatagacatctacagaactctccaccccaaatcaacagaatatacatttttttcagcaccacaccacacctattccaaaattgaccacatagttggaagtaaagctctcctcagcaaatgtaaaaaaacagatattataacaaactgtctctcagaccacagtgcaatcaaactagaactcaggattcagaaactcactcaaaaccgctcaactacatggaaactgaaaaacctgctcctgaatgactactgggtacataaagaaatgaaggcagaaataaagatgttctttgaaaccaacgagaacaaagacacaacataccagaatctctgggacacattcaaagcagtgtgtagagggaaatttatagcactaaatgcctgcaagagaaagcaggaaagatccaaaattgacaccctaacatcagaattaaaagaactagaaaagcaagagcaaacacattcaaaagctagcagaaggcaagaaataactaaaatcagagcagaactgaaggaaatagcaacacaaaaaccctttaaaaaattaatgaatccaggagctggttttttgaaaggatcaacaaaattgatagactgctagcaagactaataaagaagaaaagaaagaagaatcaaatagacgcaataaaaaatgataaaggggatatcaccactgatcccacagaaatacaaactaccatgagagaatactacaaacacctctacacaaataaactagaaaatctagcagaaatggataaattccttgacacatacaccctcccaagattaaccaggaagaagttgaatctctgaatagaccaataacaggctctgaaattgtggcaataatcaatagcttaccaaccaaaaagagtccaggaccagatggattcacagcagaattctaccagaggtacaaggaggaactggtaccattctgtctgaaactattccaatcaataggaaaagagggaatcctccctaactcattttatgaggccagcatcatcctgataccaaagccaggcagagacacaaccaaaaaagagaataccaaagcctggcagagacacaaccaaaaaagagaattttagaccaatatccttgatgaacattgatgcaaaaatcctcaataaaatactggcaaaccaaatccagcagcacatcaaaaagtttatccaccacgatcaagtggacttcatccctaggatgcaaggctggttcaatatacgcaaatcaataaatgtaatccagcatataaacagaaccaaagacaaaaaccacacgattatctcaatagatgcagaaaaggcctttgacaaaattcaacaatgcttcatgctaaaaactctcaataaattaggtattgatgggatgtacctcaaaataataagagctatctatgacaaacccacagccaatatcatactgaatgggcaaaaactggaagcattccctttgaaaactggcaaaagacagggatgccctctctcaccacacctattcaacatagtgttggaagttctggccagggcaattaggcaggagaaggaaataaagggtattcaattaggaaaagaggaagtcaaattgtccctgtttgcagaggacatgattgtatatccagaaaaccccattgtctcagcccaaaatctccttaaactgataagcagcttcagcaaagtctcaggatacaaaataaatgtacaaaaatcacaatcattcttatacaccaataacagacaaacatagagccaaatcatgagtgaactcccattcacaattgcttcaaagagaataaaatacctaggaatccaacctacaagggacgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttagagattcaatgccatccccatcaagctaccaatgcctttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaatagagcccttggaaataatgccacatatctacaactatctgatctttgacaaacctgagaaaaacaagaaatggggaaaggattccctatttaataaatggtgctgggaaaactggctagccatatgtagaaagctgaaactggatcccttccttacaccttatacaaaaattaattcacgatggattaaagacttacatgttagacctaaaaccataaaatccctagaagaaaacctaggcattaccattcaggacataggcctgggcaaggacttcatgtctaaaacaccaaaagcaatggcaacaaaagccaaaatggacaaatgggatctaattaaactaaagagcttctgcacagcaaaagaaactaccatcagagtatacaggcaacctacaaaatgggagaaaatttttgcaacctactcatctgacaaagggctaatatccagaatctacaatgaactcaaacaaatttacaaggaaaaaacaaacaaccccatcgaaaagtgggtgaaggacatgaacagacacttctaaaaagaagtcgtttatgcagccaaaaaaacacatgaaaaaatgctcaccatcactggccatcagagaaatgcaaatcaaaaccacaatgagatatcatctcacaccagttagaatggcaatcattaaaaagttaggaaacaacaggtgctggagaagatgtggagaaataggaacacttttacactgttggtgggactgtaaactagttcaaccattgtggaagtcagtgtggcgattcctcagggatctagaactagaaataccatttgacccagccatcccattactgggtatataccgaaaggactataatccatgctgctataaagacacatgcatacgtatgtttattgtggcactattcacaatagcaaggactttgaaccaacccaaatgtgcaacaatcatagactggattaagaaaatgtggcacatatacaccatggaatactatgtagccataaaaaatgatgagttcatgtcctttgtagggacatggatgaaattggatatcatcattctcagtaaactatcagaaggacaaaaaaccaaacaccgcatgttctcactcataggtgggaattgaacaatgagaacacatggacactggaatgagaacatcacactctgggtactgttgtggggtcgcgggagtggggagggatagcattaggagatatacctaatgctaaatgatgagttaatgggtgcagcacaccagcatggcacatgtatacatatgtaactaaccttcactttgtgcacatgtaccctaaaagttaaagtataataataataaaaaataaaataatataaaaaaataaaataaaataaaaacaatatcaccagagagatgtcttgtttatttccacttgtctacatgagaccaagcaggggactaattcctgtcctctgcagggcacagaggatagtgcgtgatgaaacgtagtgatgaacaacatggtccactgatgaccctgcccaaaatcataactagaatatttcctaaaacatatattattctttcactactttgtacatcacgtatttagtttgttaaatcttttacttcaaaggatagattttctttttgttaatttgtgcacatatgcatttgtgaagatttagaatttatggatatttgttataatgtatttcaagcgaatagaaaatacaacatatacccttgtatccaaattgaataaatgttaacatttgccatttttgtttcaggtatgttttaataaacttgactgataccattaaagcagccttgcatcttgttttctccattacccctcaagttggggtgtgtccttctcctcatgtgcttatcttattaatgtatatggaattacatgtagattacagattttttaaatttttgtgtgtctatttactatatttttcactcattatcagttttcttgtttcctactttttgtgggactgatcaactttcttctctactgtcttcatattctttctgctagttaaagattatatatctatttctcatctttcaatagttattcttttctggtttttttttttttttgagacaatgtctcactctgtcaccaggctggagtgcagtggctcgatctcggctcactgcaacctccacttcccgggttcaagcaattctcctgcctcagcctcccaagtagctgggactacaggtgcatgccaccacactcagctaatttttgtatttttggtagtgatggggtttcaccatggtggccaggaagatatatatatataaaatacatacatatatatatatatatttgaaaactcatgctctatatgataaatacatacaattttatcaattttataaaaatgatttattgtttaaggtataaaaatgagattgtgattatgttaaaaataggctatatgttttagaatgaatactggaatagttattaataaaaaaagaaaattattttcaaattttaaaaaagacatatacttgattttaaaaagttaaactaatttaaaattttatcttctttttgaacacaataaagtctttatagcaatcatccctcaccaatttttcatgttaattttgtctagtttttaggtctcccttatttattaggggcacaacttaaaaaatatttttatagcagctgattactttgatgtgtccacgtgcttgtcaatgtctttggtcactattctaacatactactttgggttctattttcctattcctgaagaacatgctttagtagttgtttcaccaaaaacttgtgaactctttagtagctttttgttactccgaatgtctttatttcagtctcattttataatagtagttcaactcaatagttattctagtgtaacactattttcttcagtgcatcatcatctggtgtctattgttgctgtctgatgttatcaattgcattaggttggtaagcattccctatcaggggaaaccagcccctgatatttcaacgtaggttcttttctattttccctaagtgtcgaccggtctgagaaataaggggaaagagtaccaaagagagaaattttaaagctgagtgtctgggggagacatcacatgtcagcaggttccatgatgccccccaagccacaaaaccagcaagtttttattagtgattttcaaaggggagggagtgtatgaatagagtgtgggtcacagagatcacatgcttcacaaggcaataaaaaatatcacaaggcaaatgggggcagaccgagatcacaagaccagggtgaaattaaaattgctaatgaagtttcatgtcccactgggcatgcattgtcattgataacatcttatcaggagacacggtttgagagcagacaactggtctgactaaaatttactaggcaggaatttcctcatcctaataggcctgggagcgctacgggagaccagggcttatttcatcccttatctgcaactgtataagacggacagtcccagagtggccattttagagacctacccctgggaatgcattctctttctcagggctgttccttggtgagaaaaagaattcagtgatatttctcctattcgcttttgtaagaagagacatatggctccgttccgcccagctctcaggtagtcagacctaatggttatctcccttgttccctgaacatcgctgttatcctgttcctttttcaaggtgcccagatttcatattgtttaaacacacatgctttacaaacaatttgtgcagttaagcaatcatcacagggtcctgaggccacatacatcctcagcttatgaagatgacaggattaagagattaaagtaaagacaggcataggaaatcacaagagtattgattggggaagtgataatcttcacaatttatgtttagagattgtagtaaagacaggcataagaaattataaaagtactaatttggggaactaataaatgtccatgaaatcttcacaatttatgttcctctgccatggcttcagccagtccctctttttggggtccctgacttccctcaacaattcccaaaagcatgtgtgtatgaagaaaatacttgactcacagtttcataggaaaacaattgtataggttcttaagtggttacactactactgcatttatcttatcaaaataattcaaattccattaaaatgtacatatattgaatgcatattgaaagccagggattttcataaatttatcccatttattctcacaatcttaggaaactgttttaatatctctacactttacagatgaggaaactgaagcccgtggtggtcaagtaatttacttttgatcacacagctgagaaacggcatttgcctgaggtaacctaggtcttctaattctgaatccagtagagttgcctctagagtcaatattatgtattttaatcccctcacttatttttatgacagtgaaaggagatagaataattgtaattaagatcagaggcactggtcactctcatttaagaatcgcatggtttatgaggaaatcttcctcacagggtccaaggtggaagtcagaccttgaagccccaacatgcccctgaggactgagcaagccgctcttcttcaaagcctgagagacaggaactcagctgcttgcttgcataatcatattcatgagttttagattctgggtagtttccttagctgcacgttgagaaattgaaaaatggcaaaattaaaaataaatgacttttgtaatacagaaaagcctttactctggagaaaaatgtaattcagttttcaggcacattccacttcttttatgatttgaggatatcacaaagcatgccagcaagtctaaggggatgtatttggaggagtaggtcatttctcaggtaaaaaagtgttttatttatggtgtgcaagcatgggaatgagaaggtctgggtttcagcctggacccttgatctgattcgctttaaggacaaccacaagtcacttagactccatgggcttcagttttttcatttgtaaaatgtaaaagtcaaactagatatctcttttaataggtgagctgaatatgtttccatttattggagaaacctcaatctttttatgttttatttaccatattatgtatgcatgattgtaagtatgtaggtagaaagtttttttttttttttttgctttcttttttcccttttcctgacttctgttaaactgatattgatttaaatcttcctggtcttaatgtttgtatgcctgcatgtaggtatgtatttgccactcacttgaaaaatgtacctatattttcttctattaaagattacttttaatttcttcctaatctttaaattaaactttaaaaatataattggattcatgtacagctgtaggaaattataaaggaagagcttgtgtacttttaccttgttttccccagtaataactatatcttgccgaactatagtacaatattacaaccaggatattgacgttattgcagctaacatactgaacaatttcatcagcacagggattccttctgttgctcttttataactatatccccttcctcctttccttcccaaccccacccttgatctctgacaatccctactctgttctctgttgttatatgttgtcatctcaagaattttttacaaatggactcatacagtatgtaaacatttatgattggcttttgtcttgcagcatatatcaatcattcatttttattactgtactggtagtattccttgatatgggtgtaccatagcttatttaaacaattgcctgtgaaaggacatctatgttgtttacagttttgggccattacaaataaagctgttatgaacatttatgtaaaggtttttatgtgaaaaaaagttttcatttctctgtgataaatgcttaaaagtgtaatttctggatactatggtatttgcatatttagttttaaaataacttgctagactgttttccagagtagttgcaccattgtacattcccaccagcaatatatgggtgatctagtttctctgcatctttgccagcatttttcattattgtcattatttctttattttaaccattctcataagtacatagtaatatatcattgtggttttaatttgcattttctgatggctaacaatggagaatatgttttttgtgcttatctgccatcggtgtatcctctttggtaaaatgtctatttgtgtcttttgccaattttatatttagatttttttgcttttcttactgttgaattttgacagttctttatattttctagatacaacttatttgctgaatatgtggtttgtaaatattttctcaaagtctgttgcttctctcttcatcctcttaatagggtctttcccaaagcatttttccttccatggatcatgcattgcatgtcaagtctaagaagtctttgcctagctatagacaccaaatactttctcctgtgtttttttttccctaaagcttttatagttttacattttacatttaagtccatgattcatgtcgagcaaatttttgaataagaaaatttaggtcaagctttatttttgcccatggatatctaatagttcccacacaatttgtgaaagaactatttttctacattgaattgcttgtgcacctttgtcaataatcaattgggtatagttgtgtgaatctatttctggattcccctttttgttccactcttctaagtatcaatctcttcatcagtaccacactctcataactacaactatacagtaaatcttaatattgggttgaataattctttccactttatttttttggaattgttttacatattttaggggctgtgcattttcatatatattttagaagaagcttatttatgtcaacaaaatccctgatgggatcttgttaaaaattgcatcaaatctacagatcagtttgggggaaaatgatatctttactttcttgagtcttccaatggcatgtatgtatgaacatgatgtctctttactaatttagaacttttctttctttcattgacattttataatttacagcataaagattctgtatatgattctgtgcatattattctgtaaccttgcttcactcacttattagttctaggagagtttttttttaattcttagaattttttcatatagacaattatgtcatctgcaaatagaaatgattttatttcttcctttccaattggtatgctttttactacactcaatttttagatttctagagaaatatacatttcttaatgaagactaaatttattcaatgctattttcctccctgaatgataagatgatgtcacactttaactgcctcatgttattgtttcttagagtttttgttctacctgctttaaacacacacactaattttggttaatctttttaataaaatcaatagttcattaaaattattgacacatcttatcagtttctgtgtttgttatcttttcttgtaacaggtactttcctctaggttcatttttcttgttgctgaagtagtacctttactaagtgttttgtttattaattgaaggcctaaggcctcattcttctccacagtgatatccaattttcctggcaccatttattaaaaagggtgtgtcctttcccattaaatgttcttggctccttttttgaaaatcagttggatgtaaatacaaggatttatttatttctgggttccctattcctttctattggtctatgtgtttttataccagtatcatgtgactttggttattatagctttgtagtatattttgaactctgttaatataacgcctgcaacattgtcctggcactcaggattgttttagctgttcagaatcttttgttattccatacaaattttaggatttttttttatctctgtgaaaaagtcattggtattttggtgatgctattacattgtatctgtagactgctttcactttacgtctgtgtgtttcttcattggtcagtgagcttcttgtaggcagcatacagttgagtcttccttttttttttttttattaatccatttggccagtctgtatattttcattggggaatttaatccatttacatccacagttgtttttaatagatgaggacttccttctattactttgttggtagttttttggttgttttatatactctttgttcctttcttccactcttgtttgtgtttgtgatttggtgcttttcatagtgataacattttattcctttttcttacctcatgtattttctctaccagtaaacttcataactgggcacgttttcatgagagtagacaatgtatttttgcttcctgatgtaggactcccttaagcatttattgcagggccagtctagtggtgatgagttccctcagtctttacttgtctgaaaaaggctttatttcttaaaaatagccttgctgtatataatattcttgactgacaggtttttcttttagtgctatgaatatatcatctcattctgtccaggtctgtaaggtttctgctgagaaatctgttgttagtctaataaggattcccttacatgtgacttgatgtttttctcttgctgttttcagattttttctctgtctttgacttttgatagtttgactatattgtgattctgagagaacttctttggattgaatttacgtaagaatcttttagcttcctatatctggatcttcatacctctcccaagacttggggagttttctgctattatcttgctatatgggtttttaatgcctttccccaccttcttcttctggaattttcataaggcaaacattctttcacttaattatgttctgtatgtctcataggctttttttttcattcttttaatgttctatttctttttaaacattaacaatttggttatttcagacctaatagatatctacagaactctccaccccaaatcaacagaatatacatttttttcagcaccatgccacacctattccaaaatcgaccacatagttggaagtaaagctctcctcagcaaatgtaaaagaacagaaatgataacaaactgtctctcagaccacagtgcaatcaaactagaactcaggattaagaaactcactcaaaaccactcaaatacatggaaactgaacaacctgctcctgaatgactactgggtacataaagaaatgaaggcagaaataaagacgttctttgaaaccaacgagaacaaagacacaacataccagaatctctgggacacattcaaagcagtgtgtagagggaaatttatagcactaaatgcccacaagagaaagcgggaaagatccaaaattgacaccctaacatcacaattaaaagaactagaaaagcaagagcaaacacattcaaaagctcgcagaagacaagaaataactaaaatcagagcagaacagaaggaaatagagacacaaaaacccttcaaaaaattaatgaatccaggagctggttttttgaaaggatcaacaaaattgatagactgctagcaagactaatagagaagaatcaaatagatgcaataaaaaatgataaaggggatatcaccaccgatcccacagaaatacaaactacccatcagagaatactataaatacctctacacaaataaactagaaaatctagaagaaatggataaattccttgacacatacaccctcccaagactaaaccaggaagaagttgaatctctgaatagaccaataacaggctctgaaatttaggcaataatcaatagcttaccaaccaaaaagagtccaggaccagatggattcacagccgaattctaccagaggtacaaggaggaactggtaccattccttctgaaactattccaatcaataggaaaagagggaatcctccctaactcattttatgaggccagcatcatcctgacaccaaagcctggcagagacacaaccaaaaaagagaattttagaccaatatccttgatgaacattgatgcaaaaatcctcaataaaatactggcaaactgaatccagcagcacattaaaaagcttatccaccatgatcaagtgggcttcatccctgggatgcaagtctggttcaatatacacaaatcaataaatgtaatccagcatataaacagaaccaaagacaaaaaccacatgattatctcaatagatgcagaaaaggcctttgacaacattcaaaaaccttcatgctaaaaactctcaataaattaggtattgatgggacctatctcaaaataataagagctatctatgacaaacccacagccaatatcatactgaatggataaattcataaattctttatcctgcttgatctagtctattgtggaagttttcaattgcattcttattccactcattgaatctgctgttccaatatttcaatatttctgtttgattctgttttatatctatctctttgttgaatttttcattgagatcatagttttcaagattttgttgaattatctatctgtactcccttgtttctcactgaatgtccttaagattgtcattttgaattccttttcaggaatttcatagatttccttttctattactgaagagttattgtgttcctttgagagtgtcatgtttccttgctttttaatatttcctatgtccctacattgacgtttgtgcatctggtggaacagtcacttcttccaactttatggagtaactttctcaggaaatactttttcctgtagatgtgtcctatggagttgattgggtatggtgctttggcattggttctgggtaggtgcagtagtgtagtctttgtatgatttgttcagctgtaataaatgtcagtggtgtatacaattgtctccatggcctaggctgtgattgtttgtgaaggctgtggtatggctttgctaagttgtgctggttcttgggttcttggggagtgcataagcatgcagcaactctgccttgggagaaggtaggctcactgtggcaacagttgtccccaggagggttggttctcaggctactgggaggtatatacattggcagttctacctctggaggcagtttggccatggcagctcttggttctggggagtacatacattagctccttctgctctgggggaagcctccccactatgctggatcacttgtgcgatcagggtgtagagtgctatgtgggcttggtgctggggtcagcgctgtacaattgagttcagctggtatcaagacacttcagccctcagagtggatatgggggagtgtcagcaggacttcaattatgtggagatgcagggactaatgagccccacggcaggatgcattctggtggtggctccactctcaaaatggcaccatgctgtagcaactgtgtcagaaatcccacagaattttctccctggaaagatgtagacacatggattccaggcagctccctagtctgggctcaggacctgcaagagttgtggggcttttctgtaggtagggttgcaggcatccatggtaggaatatagacttctggggatctcctgattaccttctcctcacaatggggagcctcttttggctccaagccattctcccagccaggtgctttgcttccctctctgtgctgagtttctgtgcctcagagggtctttgtcacttatttgctgaattccagtgttctcccttagacatactatttgatgtgtggttatctatttgttgttttgatctttttttgtggaggaggtgagtgctgcatgcctctagtcagccatcttgatgaccaattaaatgtgcacagtttaaagttcttgtcacaaccatcattttttaaaacttgaaataaatgtgtgttccagttgttgattttgttgactttcttactaagagagcttcatattgtgaactttccatatattttcaaattttagctgttaaatttgtttcgagtgggaagttttagtttttccctctttttcctcccagattcaccttcttctggtctggcattcttggcagcttccagtatccacccaccttcactgactctaggctttcagttgagaaccaggtcttacagtgatttttcagagctctctgcctctgatattgtggctatcacaaaccaatcaccgagccaacaggcatcttggttcagttctatggggatgaatgcttgttctatccccccagaacctctgagagcatcttgtgaagtcacaatttcaggaagcaaaaacagagccattctccccttttccacataagaaaagtgcctctacctcagttccaggcttcattgagcctgtccttagtattttttgtgaaagcactatccacatttctctctaaagattaaaactttcacagccactgctggctcacagaccagggtccagcaggtctgaggcttcattttcatttatcgtttttgtgtttctttcctgtttttgattgcatatataactcatcttttaaacccatcagtgcctttctgcatggcctcttttaatattttattgctgtatatttgaagtaaaagaagtatattagaatgtgaacggtactgcttgaaacaaaacctgaactagcactaatatcattttatctgtgtgactttatgatagagctttatcaaattgcctggatatacatacacacacaaacacaattagttaatgtaaaagctggagaaaactgcatgtgctccataataattaatagtattgtaccaatatcaattccttgtttgatatttacaacagttatatatgatgttgcagaggggaaagccaaatgaagtgttcccaggattcaatgtactatgtttgcaactttctgtgagatcgtaattatttcaaaagaaaaagtttcaaaactaaggttatatagttatacaaatatcaaattgcttttatcatttttcattcaagaactaggcagttctgaggaaaaacaaatgatatgccatataaagtcatttggccctgtacatgatgcatggaaagcattaattaaattttattttatctcctttcctagtaatcatatttctatgccaacttttttttcccagtgtgatctaccttgtgtcttgtttgttcatttatttgttcacatagcaaattcttttgaagcaccaattatgtgtcaagcactacattaagccctggaatatcaaagattaataagatagaatttctttatccaaggttcttctaatctattggaaaggaaaaaacatgtaagcagctacaaaataatctgataattatatgaagtaagtgctgccagaacacagaagagggaacatttgtctttgtgactcagttacagcatcccagagtatatacaggctagatcctaaagggtaaggagggatttttcagaatgtgaggaattttatgggataactggcctgatttcttacaaatgaatgatatgaataaaaagcatgctgggaagattgctacagattaaaagatacttaagaaggaaatcaaccaaatgatagtcatcatttgaataaaacaactgcaaaaagacattcatggtataatcaaagaaatttgaaaacaaattggatggatagtaagaaattattgttaatactgagtaatagtaatggcatgcccaaagatataatattgttaataatactgggagttacagaattatcgttatatatatatatatatacatatatatatatataattgttatttttgttaggcacaataacagtattgttatttaacttatatcctttatgtcagagttacaaactgaagtattcacaaataaaatgatatgatgactgggacttgccataaaatgctctagaaaacaacattgtggaagatagatgacatatgatgaataaaaagtgactaaatcttgaacttggtgtatgggtgaatggaaattcattaacactgttctccctgtgctaattctatgtttggaaattcccataataaaaagtaaaatttattccacaatcatcaacattttacgtagcagattcagattatttagcgcctaatcttcattttaatttattctgagtcatagatagcattgattaattgtctcagtcatggtagtaatattttcttctcagtcatagtctcttgtatttcagttaggtaccagccatgtcatcaggaattaaaaaaattttagtgaagttatttgtgtttcctctgtgcattggatgaagatgacatttttttcagagaaattactgggaaaaaaaaatcactctgccttctttaacattccatgtgtgagtgattttatcggctctgaaattgtaaacccacacttttgactctgggaataagctgataagattttaaaaccttctacccaaaagactgcacaataatttttttaaaaacttcaagtagtctcaataaatacattttgctttttaaaaataagcaaaatataaaatgtttggagctaaggatgctggatgaaggaagaaaagaaaaatcactccaggcagggaaagcagcaaattttttaacaaaaagcttatgttaggaaaatgttgaaatattgactggaaaactgggaaccaaggtggggacagtgaggatatgaagctgaaagatagttaggaaccacatgactaatagtatttccaaactaacaagttcttccccacaaagaattttactgtttaatccctataggcaagagataaccaatgcagatttgcaacgaaggaataacagagctgtgtttgttttgtatgtatctcaggtagtgatatggagtatggaataaaggaagaatgagctggcatcaggggaatcaatgaggaaccttttttaatagtataaacaatagacaatgagggctaaactacatcatggcattgagaatggaagtaaatgctttgtctgcaactaattcagttaagacttcgaggctcactgtaagaggtgggaagaagaggaacatattacttgatggtaacatcattaaccaagtgtgagaatatggaacttagagtaggcttggggagggaggacgtaatgagcacagtattagacatgttaatcatgaagctctataggacaaccaggcagagctcatggctggaggctagctgtcctttgctgaagcaaaatatattgtctattgtagaatgagaagaccgaaggcaaaactctggtgaaccgacaaactaatatgtgaaagaacttgtaggctgaaagagtaatgggcagagacgaggagaaccatagtaaaatattgtctagggtaatttcagaaaaacttcttggagtaagtgagatgaagcttgattatgttagaataccatattagggagctgtaagaatccatgaagaagaaactctaagtaaacaaacataaacatgaatgtgcatatttagctaagtaatttgaagcaatctgagtctacaaagcctttatttttgtttaattatctttgtgctatttgcttcctggtagtttatattctcccaaacttatcatgggcataattaaaagcaggagaattttaattaatgctgattgcattttattgtgagacagttgcaaaattcaaagcctttgcatcttataacaatgagctgcagggttttagctcttggtttttataaaatgacagttgaggtaagaatgataccaataattccctggtatcatgtctttcccttctttattgatagtaaatgtttccttttattttgtatctacaaagtcaattctcagatatctccctgccaaacgtgagaatctgtggcaaaattttacattattaaaatagaaacacaatggtgggttttattttatcctttgcttatttgtctgtttcctctttcactatatcaagacagaggtcttgtctccataccaaagttcagtttttatactcaaacacttaaatatcttttctattcttaacaaaagtttctgggaaatttttcttttaaggttatgatgtttcttttcagaagaaggagaaagagcagttgaatactggctggtgctttccattagtgttacaggtaatttcatgtgtaatgaggggaactctttgggcaagaaacagaatttggaagacaattctgcttccctttttgaattgtgtcattattttaaaagtgttcatcaatttctaaatcatatactgaaagtagaagacacatacctatgtgtcctgatctacatctttaacaaagaaacgtaagcattagttgagatgataaaatatgacatataagcttgctaaaatgacctttttcagctcctgtacccttctcttttggaggacacgacaggtgggtgttccctgagaaggtattcacaagcccatgagtgtgagttttactaaatgacattaaattattgaaaatgtaaaattgggaaaataatgaatttttatttgccaaataaaaattcggcgaatttttatttgccaacagagaccccccagaagctgtacttttcgatgcaatgttcctatagccttgctacggaaaagcctttatagagggtgatgggcaaagccacagattagggctggaaaaaaatccctccaggatacaaatttgaagattcatttttctcattactggtttacaacccagtgtgaagcttaaattggattgatcaaggtggaaaaatctttctgttatcaaaatggagcatattgccaaaaggaaaaggcaccaactgacctatagtgattgttctattgctgattttatcttcttcatgctagggcataatttatttcctctcactggaatggaagagaatctttgaaggagtctgagtaaaaggcagcaaaaggaaaattctattgataaaaatacaaaaattgaaagcagttgaaatctttaatataagaagtgtttcaagaacattaatatgaggtaaattatgtactaatcaattttaaagcattttaccttaacagtctgacccgcatgtacataacatacatgctgattttgcatggcttcttaagtattagaatgaaagtatcccaaaatacctaaatacctaaattaactaatctaggaggatctaagtaaggacaatacaaggaacacttatgtttgaacccagtttggaacataattttcaactctttctcattttctgcactgatgtgggaggtcactgatgttatattatacttgtcattcttgggctaaatattcaacctgcactgttatgtgtaccttgaggagtcctaggagcagtccttaggggacttccttttgccgaaggtgtttgctagtgaataaatgcagtcgtgcatcacttaatgacaaggaaacatcctgagaagtgcattcttaggcaattttgtctctgtgtgaacatcacagaatgtacctccacacatctagatggcatagccttctacacacttaggttatatggcatagcctattgttcctaggctacaaacctgtacagcatgttattgtaggcaattgtaacacaatagtaattatgtagatatctaaacatagaacaggtacagtaaaaatgtaggtggtataaaagatttaaaatggtacatctgtacagagcacttagcatgagtggagcatgcaggactggaagttgctctgggtgagtcagtgggtgagtggtgagtgaatgtgaaggcctgggcgattactatatactactgaagactttataaacactgtacacttaggctacacaactatgttaaaacaataagtaattatactatgatgttatgacagctgcaatgtcactaggcgacaggattttttcagctccattataatcttatggtaccatttttatatattcagtccactattgaccaatatgtcatatgcagcagatgactatatacaaaagcaagggaaaccacagttttttcttccttgatatcataatgtttaatacagataaattacctgtaacactgaacagaaaatctcacaggatatagttcaataatgttatggagctgaagactgatagcaaagtcaaatacagtatttataaaatgaattttttgtgtaattagttttaaaacctagcatcatactaaggccctcagatttcaacaaaaagaagaatgttgctttgagacgattaaaacagactgattaagaaagcccttcgtaacctggcacaaatctacctttccacttcaagacagccactttctgttatgcagctcaagtgtaggagtaccttccacctttataatcgctggagatttgtatatttagggcaataattttctgacagatgactaagggcaaggctttctagttctcagaaaagtgtcatttgggctcaaggtagtgtcattcaggctcaaggtagtgtcattccaaccttattcgctatagtatctaaaatcaaactctcacaccagttgtcttacattggattccatgagaaacaagctcgctggtggaaagtttcatacaagaaatttaatggcatatgtgcttgcatgaatgaacacctggaggaagtacaggaagtaggattaagcagaggggagaactgaactgctatgcaatcttaacaaagacatcaggcaattccatgggaacacttgagctgtgatatcccttcaaaattgttcactttgagggaaggagattgagattttatacccctgcattgaccagccattggatatggactcttacaggatagaggacatgacattgggtcagacatttttcttcagctgagagtaattccgtgaaagtatctgagcagtaaactatcaaccaccaatattctcaatagctgagagaatgagtacttggtcccgtatggggaatttgagtggcatgccactacacctactacactagccctacctttgcagtattctcattgtttctcctatccattaatgtaacagatatttattaggtacccaacctactggatgccagacatctgctgggtcttggcaacataaatttgaatataaagtgattctgcagtctaagcggaaaaaataccacctcttcaacacacacacacacacacacacacacacacacacacacacaaatagtggtgagtgctctaaaaatgatagacacaacatgctttggaaatgcaaaggagaaaatgtttgacttcctggggaaatttagtcagtcttcatgggagaaacatgagcctaacatatgtatattgcaatttccatgctttctacttgccctgattgtcctctccactatatttcacctatttagagcctcttctatatggctctgaccagttctaactctaccacaagctttatatctaccactatttaacccactttatgatctgagcaacctctgttgtgaactgcactagaattagcccctgatgccacatgccatttaccttctcctggaggtgtcatgtcactctatctaaatggcaaaaccagcaggacagggtcaacacaatacttaagtgaagattgtcatatcacagaatgtagaacccaaaaagtatttagagatgatcttgaccaagcatgtcaaatgcaggggagtggggcaggcaagaaaggaaattgtgattttcttgaggtatttcagcaaagaaagcaaagatttaagcttaggaccaagtccatggaccccacccattgccttacactatctctgccaatgaatgaaaccattcacaggtttagtcttaaaaaaagtttaaggaaactttgaagtatgtgttagaaagtagacttttttcaccaaagtaatagacaaactttatcaagctgagtgatcttatttataactcccatggactattctgttttactagacacatttaggggaagatcaaaagtatcttttattggagattcaacaaatggttggggcaaatccataataaattgtgtatgtccaattgagctactatggagaaactgaaaatattgaaaatgtttttgttctctctaatctttatagtctgtttccaaaaatgtccaggtgatataatgagacaaaattcactagtttagataaactactggcttgaatggctttgacaatttgtgtatctgcatgtgtgtgtgtttgtcgtctttatgcatagctatatttaaaccagccaaacctactgagcgaaacaatggtccctaaacctgactgacaatcagaattacccagaggtattttcaaatattcctgagtcccagtctctggagatgtgcactgaccatgtatgatatgtggtctaaacagctacctatgagaggctccccagataatcttcagtgcagccaggcttagaaattgtattataaagtatggggtgacagagcttggctgctctgtggtgctgctacagagggcagagtggtcctgccctctggcttatggcccctgactgctggtcagcttcaggcagccccactagtcacagagaggtctggagtgagggaaggaagggcaccgcagcagccatgccgtgaaaactgacaaacatattttacatgccatgtcaatagcatccctgaaggtgagttctaacaagtgcctcactctaatataatacttgctcctggctcaggcctcctcctcccctaatcatcgagtcacgtactctacacccttctctgctcatctctgataatcatgttggaaattgcctaaagagatactgcactttaataacctatgttatcttagcctcatttcctaacttaaaagaacaatagatcgttggaaataccatgaaggcaatttgagccataaaggcataaacaaaaataggtattaccataagagtaacaagtggtgtgtgtgagtgtttgtgtgtgtgtgtattcttaaaaatctagtccaagaaaatgaactttatttatttaaatttgcttgagtaaggccttatgcatttattatgatggcagatcaaaccctgctcaaaaatgtgatcatcatctctactgacttctatattctctttaattcagaattattaagttctcttaggcagtacatattaaaatttccttggagcaagagtctcttttctctaactgtgttaaataagatttcccacgtaaaatatttctatccattccatagtaacaaggctgattttaaatggatgaacgtagagaaattgagttccattccctaaacactccataattaccaaataacaggcactgattgctccaagacaaaaacctgatctcattagtacctgctgtttgggtagggagaagacaattacatgtgaagggtactaagcttttggaaatgctaattaattatacattatttattggaaatacaatgctctccttgtactgtagctaggaaaacagaggaagtgtaagaacttaaacagctgagacatgctgaattgtaatgaactatagtcattgtttcaaatctgggatcctttactggtttaaatacaatacctactctcaaagtctttttcttttatcagaacgggctatcaaggtctaagagtgtggaaaggaaattactcagttatttggcaggctttagccaaactaagctggtataggtggtttaattttcattttacaaaggtaaataatagataaataagtaacagtaaatagtaaataaacaatttcccagcccaaaccaaaaggctggtatcaataaagagataggagcttggcatgtgatggtttctgacaaagtaaattgctttgcatcattgttgtagaattgtacccatgctataaagtctttatacagtgctttcctgttagctggcattagtaacaaaagactaagagagcatgggatctctttacacacgaggcaaagaactggaagtaaggacttccatttctcacaagcctagcaatttgccttctctgcagtttatatgtcaagtgtgccagggaaaaaaatagccttacaggttaaaccgagcagtgttaccttgatttgctctcataatgtgatttttaataattatccatcaattcttccaaatatgtggagagcaaatgctagaatgtgaagaatacatatagttaacttgaaatttttatgtaatttattatttcacctaaatcatctggctggcagcatgacacatgggcaagaggcagatgacctgtgtgtctctctgacacctgctcccaagtccattattatcctcaattctctatcacatgaatatggtagaccagatagaagtctacaaacttaaaaatatatatattgtgtaaattttaaaacaaataagagtagacaatacagtataatgaagctctatgtatccaccattcagcttcaaccattggcaatacaatttctaataattaacattaagaaacattaagttaataagtactcacacatggcttatatgtaaattataaacagttatgtttacatttatgagctacaccaaggtattatgcacattttagaacacagatcataagtataaaattttaaaacatggaataaaatataatgaagttctgcacatgaaagttcatagcagatttatatgtgacagctgggagctagaaaccatctagatgtccttcatcaggtgaagagaaaagccaacaggtatattcacacaatgcaatactactcagtagtaaaaaaaaaaaatttaaaaaaactattgctatctattgatatatgcaataacattgtaagcagccagtctgaaaagacaacatattttgttgttccactttttttcacattctagaaaagataaaactattgttacataaaattaatcagtgtttgccagaggttataggtggggtaagaatataattataaaagattatctgagacagttctttgaggtgataaaactgtcttgagcctagttgtaatatggctatacaaatctacacacatattaaaattcatagaactgcaaaatacatgccaaaaaagtccattttattgtatgataatatacaaaaaaagaattaaaaaataatcgaatttaaatgctttctctttacaatcacatggttcattactcacattaatttaagaaccagtagactagactacctctaagttctctgttagtgatgatcataatctgaaataatgaggttaatataataaactagctaaaaaaattttgacgcttctcccattgagacaggaggagtcaacacccactctttgaatctgttagagctctgtgattgctttgacaaatggaacacagaggaaatgttactatgtctatttggggagccagatcttaagatactagaagcttctaccttgacatggaacacttactcttggaactcagccaccatgctgtgagaaaggccaagcaagcagctccgtagataatctcatgaagaaagaaactaagactcctggctgagctcccagccagcagctaggaccaacttgccagacatgtgagtgagtgaggctgttggaagtaactatctagctccagtcaaaccacccctgctgacgctgcaaggatggagatgagacatcccaccaagcactttctaaatttcagaatcatgatcaaaataaatcactggggttgtttcaagctgctaagtttggggaggtttattatatagtaatagtcaatttgtttgatagataatataataatagatatgtttgttatatagtaatagataatacagaacttaaaccattcttcaagaaaaagtaggcttcagagtcatgagttattgccttaatgcagaggttttttagtgtgtcaacctcagcaacctgaataagaatgatctgaagtgttgtgaaaaatgccaaacctaatgcatcagaatctcttgaattggggatccagaaactcagttttaacaagcttcccacatggttcttctgcatcctaatgtttgacgcccagcatttcagtcacactgaaaagattaattgaaagtaactggaccccaggatgatgtcacacgtcactaccacaaaaggtaaagaaacttagtgaagaaaaaaataccgtaagcaaaccaggtagagaggtccctgaagtgggcttgttctacaagacaaaatagagcccagcaaaggataaattctaaatgggcatgaaaagtaagagataataagatcaggtatattgccgaaaatagatatgacataaacagacatatcatattaataggatatttaagtcctgtgattttatgatttttgacaaattaaataagaatgataacatgaaggcaagattaacaaggctaaatttattttgttgtttgttaactagatagatagatgatagatagatagatagatagatagatctatttaaaaggaaagccatttaaaagctataaccacctttctttctttatgtaaatacaaacttttaaattcattagcaatattaatggctaaactagactcccataaggtattcttttcactttcatcccaaaatgaaagagagaaagagagaaaaggaaaaaaaataattgctacatctgcttcaaattaactttgaaataaagtgggaaatgaacaaattgaagacataaacattgtgttctagttactaaaaaagcaaaagcatgcatcaaaggagaagccagaatcctattgtagatatacatatttcaaactcaagaagctcaaagtagtctctgaaaggtagaaatgaaagggatctaagagtcatgatagaacatagaaaatttctaggtacattttcagaaacctatattttctggttttgttttcattttttaccagggctaaaagtcacctggctcaacattttctatagactttttgtagccacttatacagtatctatgattcatatttaattattactgttttctcccactaagaaacaaaaatccagacttttccctttatactcaatatgcagaagtgtactaggattaaacctgggttgtagtagtaaactcaagagttgatataaatggtaaatagcattaaccaagggactgaataataagataatacatgtaaacatacttaatatagactcctgcacattataagggcccaattaacataatttgccttaaatttttctaaagctaaattaattccttttgctttatgttatctctataaaagtagttatatttctgaaaacctgtcagaaattaagcataaaacttccactgagcagcagggccctctccactccaagcccaggcacttggacagctcaatcagcagcctgagctgcccaacccttcctgtgcagagactgtggtgcaacagggtcctctatgctccacacccaggattaggagtttacctccccaccacccatgcagagaacttccagcagaagagaattctcacctccatgcctagacacacgtctcagtgcttagtgccttctcactggacatcccttcagcactgatgcttgtgcctgccattggtggacctgcaagcaggcctgcctgtttcagtcccacccatcttggaccctccccacagggatgagcaagaagctcagactgccctatatactccacgtatcagcccattgcttgaggcagcagagagagtttctctcaataaataataatcaactatcagacccacctgcagttaactcttacccatatgcgccatcagttggcctgtagtttgagttacacagcccaatataagacctgctgacagaattgcgtagaagaaaagccaaagaccctaccccagcattctctacagtcacacctcctaggaaagtagggaaaggaaaatgaaaaaataaataaatacaagggaaaaatgaaaaaaattacaaaatttaaaagtgccagcatccccagatgagacggaaccagcacaagaattatggctccatgaaaaacctgaatgtggtgacaccaaagaatcacactagctctccagaaatcctccctaaacaaaatggaatttcagaaatgacatgaataattcaaagcatggattgtaaggatgctcaaatgagatccaagacaagtttgaaatcaaaacaaagaaacttctaaagcaatccagaaaataaggaacagatacatagctttaaaataatcaatcagagcttttggaattgacaaacttacttaagaaatttcaaaatacaaatgaaagttttatcaatagactagaccaagcagaagaaagaatttcagagcttgaagactagtctttcaaactaacccagttagctaaaaataaagaaaaaaaaattttaatgagcaagaccttcaagaaatatgggattatgtaaagtgaccaaatctatgaattattagaattcctgagagaggagaataacttggaaaacatatttgagacaataattcaataaaatttccttaactctgctagatggtcagacatccagatataagaaatccagagaacatctgtgagatgttatacaaagcaagtattgtcaaggcatatagtcaccagactgtccaaggccaacgataaagaacaatcttaaaggcagcttaaaaaaagaaatatcagaccatgtacaaagagaagcccatcaggctaaaagcagacatctcagtaaaaaatatacaaaccagaagagataagaggcctattttcagcattcttagagaaattccaaccaagaattttatatctcaccaaattaagcttcataagtgagagagaaataaaatcttttccataaaagccatcactaaggaaattcattatcactttaccagcattataggaaatccctaaggaagttctaaacagaaacaaaagaacaatacctggtatgaccaaacagacacacacacacacacacacacacacacacacacacacacacacactcttaagtacatatcccacagactctataaagttactaatatatagaaactacaaacagtgaacaacttcacaataggatcaaaacctcacatatcaatattaaccctgaatgtaaactgcctaacaccccacttaaaaggcacagagtggccaggtggataaaaagcgaaaacccatctgtctgctatattcaagagacccaactcacatgtaacaacactcataggctcaaagtaaaaggttggagtaaacattatcattataatgatattttatcattatgtaataaaacattattacataatgataaagaatccaattcaacaagatgacttaactatcctaaatatatatgcacccaatattggagcacccagatacataaaacaagtacttctagagctatgaaaagacttaggcagccaaacaatcatagtgagggacttcaacacctcaccatcagctttagacagatcactaaggcagataactggcaaagatattctggacttaaactcgacacttggccaattggacttaagagagatctacagaatatttcacccatcaaccacagaatatacattcttctcatctacacacaaaacatactccataatagaccacatgctcagccataaagcaagtctcaataaattcaacaaaacttaacatacgaaccattgttttggaccaaagtaaaataaaaatagcaatcaataccaagaaaatctctcaaaactacacaattacatggaaattaaacaacttgctcccgaataacttctgggtaaataataaaattaaggcagaaatgaaaaaattctttgaaataaatgaaaacagagacacagcataccaaaatctttgggatgcagcaaaagcagtgttaagaggaaagtttatagtgcaaaaaacctacatcaagaagttagaaagatctcaaattaatgatctaacatcacacaaatacaagaacaaaataaccccaaagctagcagaagaaaatgaataaccaaaatcagagcagaactgaacaaaattaagatgtacaaatccatacaaccgatcaacaaaaccaaaaattggctctttcaaacaataaacaagattgaccactagctagattaacaaagaaaaaaagaaagaaggtcctaacaggcaaaatcagaaatgacaaagttgacattacaaccaatcccacagaaatatacaaaagatcatcaaagactattatgaacacctttatgcacacaaactagaaaatccagaggaaatggatcaactcctggaaacaaaacaacctcccaagattgtatcaggaagaaattgtaatgctgaacagaccaatatccaattccaaaattgaatcagtagtagaaaacctaccaacaaaaaaaaaagccccacatggattcacagccaagtcctgcaagatgtacaaagaagagctgatactagttttaatgaaactattcaaaaaaattgagggggagggactcctccctaactcattttataaagccagcattaccctgataccaaaatatggcaaagacaccacgaaaaaagaaaactacaggtcaatattactgaagaacatagacagaaaaatactcaacaaaatgctagcaaactgaagctagaaatcacatcaaaaagttaattcaccatgaccaagtgggctttatttctgggatgcaaggttggttcaacatatgcaagtcagtaaatgtgatttaccacataacagaatgaaaaacaaaaatcaaatgatgatctcaatagatgtagaacaggcttttggtaaaatccaaaatggctttatgataaaaacactcaacgaattaggcttagaaagaacatacctcaaaatagtaagaacggtctaagagaaacccacagccaacatcatactgaatgggcagaagttggaagcatgccccttaagaacaggaagaaaacaaaaatgcccactctcactactattattctacctggcactggaagtgctagccagagcaatcagtcaagagaaataaataaaatgtatccaaataggaaaagaagaattcaaactacttctctttgctgacaatatgattctatacctagaaaactttaaagactctacccaaagatgcctagaactgacaaatgagttcagtaaagttttaggatacaaaatcaatgtatgaaaaccagtagcacttctatacaccaataacattcaaactgagagccaaaacaaaaatgcaattccatttataataactacacacacacacaccacaaatacctaggaatacatctaaccaaggaagtgaaaagatctctacaaagagaactataaaacactgttgaaagaaaacataagtgacacaaacaaatggaaaaacattccatgctcatggattggaagaatcaacataaataaaaagaccatactgcccaaagcaatcaatagattcaatgttattcctatcaaattaccaatgtcatttttcacagaaccagaaaaaactactctaaaatagtttttagagtagttggctttaatagccaaggcaatcgtaagcaaaaagaacaaagcctgaagcatcacattacctgactttaaaatatacaataaggcagcagtaatcaaaacagcatggtactggtacaaaaacagacagaccaatggaactgaatagagaacccaaaactaaagccacacaagtgcaaccatctgactttgacaaagcttacaaaaataagcaatgggaaaaggactcccctattcaataaatgctgctggaatcactggctagccacattcagaagaataaatttgaatacctacctttcacatatacaatactgaaaatggattaaatatcttatatgtaagaccttaacctataaaaatcttagaagaaaacctaggaaataccattctggacattggctttagcaaataatttatgactaagtcctcgaaagcaattgcaacaaaaacaaaacttgacaaatgggacctaattaaactaaagagcttccgcacaacaaaagatactattgacggagtaaacagacaacctacagagcgggagaaaatattagcaaactatgcattcaacaaagatctaatatccagaatctatagggaacttcttcaattcaacaagcaaaaagcaattcaacaagcaaaaaaccagtaatcccattaaaaagtgggcaaaggatttgaacagacactttttgaaagaagacttaaaagcggccaacaaacatatgaaaaattgctcaatatcattattcatcagagaaatgcaaaccaaaaccacaatgagatacatcctaccctagtcgcaatggctattattaggaagtcaaaaaacaacagatgctggtgaggctgtgaagaaaaagaaacacttacaccctgctggtgggaatataaattagattaccttccatagaaagtggcttggaaatttctcacagaacttagaactaccatttgacccagcaatcccattactgggtatatacccaaaggaaaataaatcattctaccaaaaaaacacatgcactggtatgttcattgcagtgctattcacaatggcaaagacatggagtcaacctaggcacccatcagtggtggattggataaagacaatgtggtacatatacaccatgaaatactatgcaggcattaaaaaaaagcacaatcatgatctttggagcaacacagatgcagctggaggccattatcctaagcgaattaagactggaatagaaaaccaaatattgcatgttctcacaagtggaagctaaacattgggtacacatggacataaatatggaaacagtaaacactaacggaataccagagaggtgatcaagagctgaaaatctacctatttattgctctcctcactacctgggttatgagatcattcataccccaaacctcagcatcatgaaatatactcattcaacaaacctgcacatataccgcctcaatcttaataaaagttgaaattatttttaaaaaaatttccactcaaaccccacatctaacctaaatgttttagtataacatactaaaacatacccttttattttagattttgtatggtgtcctgtgacaataaaatgtatagggaagatttcataaatgtactaaatataatagtacatttcatctgcaaatttcagaacttttaaaatttcataatgtcagtctgaccttttctggttgtcttcaagattcccatttaacaaaaccagaagacaaagcagtagctcctcttgtcaagtaggtagaattacatggtttttctgatagcaatgacagtagataacaaagttgccagcatgagtcagcctggctggagctgagtggagggcttctcactgcatcatcctgttatgctttggctccaatgctctcaatatcttcttgaagtccatgctggagatgactttggcaagaacaagtgtccagagatgattaagaaacaggacttacaagaacttaagcagcattaggcctagtaaagagttaaagatgcaaatatctgtatgaagagttgagcagagtaaaacctaaaccttttattaaacaaaaaaaatgagttttcctggaaagttgaagtgtgataggtccatttattattaaagggagtaaatgcagtttctgccaagttcactcacagaggagactagactcagtgtcctgcctctgtttgacattctcacaagattccactatttgttttctaagaaaacattacctagtagtagtcagcttttccagtgttagaaccttgtaaatgacattgtgtataacgcactggcatttatttttaatgaatgttttcttctttctgtcttctcaaacttgcaatttatttaagatgtttgaagttgattgattctatgtatcttcatagatagggaaggtaacactctctccatttcagttaaagcattccttcatgattcttttaaatcagtgatgaatgatttaataatgatcacaactgctgaaccatagtttggaaattcagtaacatagaggcggaggaaacgcccttatagttggtatcgggaaacacaaagaattattttcctacatctgaaaattccagtaaggttttagagttatcttaaagtaatttttaattgttctgtgaaaactttttattcttcacatgaaaacaatgtgtaaggcattgtattagagtgcccacacatcgtgccagttctgatgaccacagcatggtatttctatttcaactctgtagctgaatatttcccatttcccatctgtctgctgatttgtaacagaataattattttatagctagtagatttgacaaaatgagatgcaatgtcaaataattttcacacttttttctaaatgcaatatgctttggggttactgaggaacaaaagattctgaattaattcactttgtcgctgatgacaaaaacaactagaatttgcaaaggtgatttatcttaattaaacatgagttaacatatctccccaccaaaacaaatcctatcataggaagctgcaatatgcttgggggcttgatatccagagagacttcaaatttacttgaaattgcattagttgtatagtctgggtttattatgtgcaaggtacgtcctaatgctgataagaatgataaaagtaaggataaactcttttaatgcgtaaaaacttaggaaaacaaaatgtatagagaggaagtacttaagtcctaggacgtagaagtgtgcaaaggtgtgtgtgtgtgtgtatctcactctgaacaataccgctctgtgtgtgtgtgtgtgtgtgtgtatataaaatgagcatatcatgaaatatactcaagcatattgcagcttcctatgataggattccttttggtggggagatatattaactcatgtttaattaagagaaatcatgtttgcaaattctaattattttcatcatcagaggcaaagtgaattttatatatatacatatatatatacacacacacatatatacacacatacacacatatatattgttcaaagtgcttcactgaacaccagaggagttaggtgggacatttagaagagagatttgtacatttggtgaaactttaattaaaaatggaagatgcaaacaagtaaaattgtgtagctagaataactctcaaattatcttataattgtcttaattgatgtgtaaatgttattctgctcccatgtatgtctacataagtttctgccagagaaaattcatcttgcagatcaagcagatagggatattggttgatgagggacttattgactccatatacggaagccttttgtatttgtgagacacaattattaggcatcagcactaaaaacaccatttgcatatgtatcttaacttccacaaaataatcgaaaattatatccaaaagaataaactccttagcatttcagaagctgatttccaattatcccagtaaaatgtaaatgtgccagacaatatttttgtttctgggggatcaccagaaaaacttggactcttctaatggaaaataaaagagtgattttttattaacttttagctttggataactcgggtagaaattgtaatacacaccagcgtcatctcccatcttgctcctgagtacaaggattgtaggcatttaactccattccacagctctccagggtgtagacatttcagacataattttacctcccttcgtacacacacccaatcctatctcacacagctatctctctaataggcagaaatcagacagtgatgcagtttctctgttatgttgtttttgactctactactttcctccttctaaagacataacaacaagaattccttgtctattatcaactttttcttctttatttacgcacgcttaattttcttttttcaaccaacttaaaatctgctaagcctgacagactattctatttaaagattttagaggatttgcctacattaaaaaaaaaaaaacaaaaacgactttcacaccaagacagaataaaatagaaatcacctttgtctctatcaaacaaatttggatttcctaaaaagtctcttaaaaattggtagaaaaaaaacaaaacatacccgtatttgaagcggcattattttagctttttgaaatgcttagtaaaaggaagtaaatctgttgtagagacctcatgatttggtatgtatcaaataaatgaaatcagaagttggtttcaaactagaagatcaaataactttttttcttttaatttatttgtttatttttagaaatggtctccctctgtcacccaggctggagtgcagtagtgtgatcacagttcactgtaactgtgggctcctgggctcaataatcctcctggagcccaactcctgggctcaagcaatcctcctgcctcagcctcctgagtagctggtactacaggtgtgtgccaccattcctggaaaattttttacaaaaattttgttagggtctcactatgttgccctggctggtctcgaactcaggcctcaagcaatattccctccttggcctcccaaagtgctgaaattgcaggcatgaaccaccacacccagcctgcctaagacatttataaaatgccttccccacattcaagaatcatacattagttctagaattttctctctagattgtaaacaagattgaggatagaagtaaattttcttttcatgcttatgtattcatatccacatacatcccctccaaagcactgctcttagtaggcattcaataaatatttttgaatgaataaatggcttttgtaaatacgagctcagccttactgttatcactaggagaaacaaatatatttctggcatacatcttccttaacctacattatcctcctactgctaattccacatgaaaaatagacatctcaaaaggatattgacttatttagtgacctggtcatgtacttagtgtttacaatgcatataccattgttcaacatagtctgctcagttccactatagacatatccatcaagctttctaaaaaaaaaaaaattaacagtaaaacatattacctttccttttgagcttgatttatttaaacctggagggtcacaaaaaaaaaaaaaacaatcagagagaaattgagtttccctttcttcttgttcctgtccttttacactgctctctacatttttgtgctaaaacttctttttatgaagagacttccagaagtccagattgcttgagaggctcagattgataatatctatgctgtattaatgctgattgaccttccgggataaaagggacttcacaaataaatattataattgcaagcaaagcaaatattaccagattgatttctccaaccattttaatagtattacatacctcttcagttcccagtttctatatttaaatgttggcaactcagcccacataaaggaaaaatataactatggcaaaggaaggggaaaatgtctctattgaatatatggcctactgagaacatctgagaaagagtcatcaaaccatgcctctgttgttcatgcacaggtatgaacagcagtgcatcatcatggcacctctggaacagctaggagtatgcttgctttttgcacacttttgcattttccccagggactttcaaattgaagaactcagctagagggttcacacatctactgcagccaggtctttgtggtaggtagcataatggacctccaaagatgggcttgtcctaatccccagacctgttaatatgttatcttacatagaacaaggtactttgcagctgtgattataattaaggaccctagaatgcggaaattttcctagattattcccaggagttcaatataatatttttaaattgataaattataataatcataattgtattacatttatggagtacaatgtgatgttttcatatatgtatataatacggagttattaaatcaaattaattaacatatatatcccttcccttgcttgacattttttgtgatgacatctttgaaatttactctcttattttgaaatacacagtacattattattggctatggtcaccctgctgtgcaacagatctctaaacctcctgtctagctaaaactgtgtatcctttaaacagtaactccacattctctcactcctccccacccaagccccccatccctggctctggtaaccaccattccattctccacttacatggatgaatcttttttagatttcacatataaatgagatcaagtagtatttatctttctgtgcatggcttatttcacttagcataacatctgctagattcatccatcttgtcccaaatgacagaatttcatctttttaaagaataagtaatatttcattttgtttactctattttctttatccaactgttgatggacaagttgattccatatcttgactactgcggataatgctgcaatgaacctgggagtgcagatatctctttggcatacttaataatttcccttgtaatacccagtagtgggattgctagatcatatgggagttctatttttagtttttggaggaaattccatactggtttccataatggctgaaccatttacattaccaccaatagtgtacaagcattcccttttctctacatcctctccagtggttgttatctttcatctttttggtaaaagccattctattgggtataaatagatatcttgttgtggtttttaaattgtgttttcctaatgattagttcatttgttaatgaaccttttggccgtttggatgagttcttttgagaagtgtttgttcaggtcctttgcccacttttaaatcggtttatttgtttgcttactattgagttatttcagttccttgtatattttgtacattaaacccttactagatatatgagctatctgaaaagaaagttaagaaaataatcccatttacaatagcaacagaaaaaaatttaaaacttagatgtaaatttaaatcagaaggtaaaagacttatatactgaagactataaaacactgatgaatgaaattgaagaaaacacaaataaattgaaaaatatcccatctctatggactgaaataattaatattattaaaattcccatactacaaaaaataatctacagattcaatgcaatccctataaaaatttcaaggtcatttttcaaaaatggaaaaatcaatcctaaaattctgtggaaccacaatacaccccagataaccaaagtaatcttgagcaaaaagaacaaagctacaggcatcatactacctgatttcaaaatgttttataaaagtgattataattaaaacagcataatactggcataaaaacagacacatcgacctatggaacaggacagaaagctcagtaataaactcatgccttcatggtcaattgattttttacaaaactgccaagaacccataatggaggaaaaacattctattcaataaattgttcaaggaaaaccagttatccacattcagaaaaaaatgaaattagacccttaccttacactatgctccaaaataaactcaaaatgattaaagacttaaagctgtaaaactactagaagaaaacataggaaaagctccatgacattggtttggacaaggatttttttagatgtaaccccaaaatctcaagtaacaaaagcacaaatagacaaatgggattgcatcaaattaagaagcttctgcacagcaaaagaaacgatgaacaaagtgaagagacaacccatgcaatgagaaaaatatttgcaaaccatgggtctttacaagtggaagagagaggcagtagaatgagtgggtcatacagaggagatagaattcagccagttgttggttgttgctggctttgtagtttaaaggggacccagatgcaaggaacacagattaagctggaaaaggcaaggaaatggattgtcccctagagactccagaaaaacagttccctgctaacgtcttttttctttttttaattaattaattaattaattaattaattttttatttatttattttttttgagacagagtctcattcggtcacctaggctagaatgctgtggtgctatgtcaactcactgcaacctccacctcactcattcaagtgattctcctgcctcagcttcccaagtagctgggactacaggcacatgccaccacacctagctgatttttatatttttagtaaagacggtttcaccatgttggccaggctggtctcaaacccctgacctcaagtgatcagcccacctcggcctcccaaagtgctagaattacaggcattagtcaccatggccggcccctgctgacatcttgattttagcccagggagattcatgttagacttttgacttctagaaatgtaaggtaataaatttgtgctttttaaatgactaagtttgtgatgatttgccacagcaacaatagggaactaatagagtgctttttcacgcatttttttctcatctatgataagagagctttctgtgtctccttctgaaaggaaagtctgctgtaagagggagtgctgttcactgcaacctcactcctctcctttgctggtgtatgtaccaatgtataacctttctgcacaaatgaaatgccatgcaagaagtaaaaagtttgagaactagcccatttgtcagtaggagtccaaaactttatactaagaatcctaaatccgataactaagaagtgacttgaggcactcgcaacttcattattaaaggttatttgcatgacaaattaatactgtagtaacagtagttgccaatgcaaaagctaaaccaagaacttaaatgccacaaacatgcagattattggcccggttgatggaacagggcaactttggccttaaatattttttggcaacttaacatatttgcatttttgcctcaagctatttaaatattttaggattccattatttacagagagcataatgggggaactctccagagttactgaaggttaaaccggataaaaagtgaaagtatccacagaataaaataactccctagatatcttgtgtacacatgtccaaccaaaaaggacaatttatttccacatatggtagggatttcagattccttcagaaaatttcagattaactccttatatttaggagtcttaattaagctgtaggttatcacttacaacaaaatgtgaagtcagagtaaatgaaaaatgttactttttacccaagaatagagtgggtcctcactccattgcttcacaagataaaattgtaattgtcttttacttcaacgttaacagatattgatagttgagccttaatgggaacactttgttttgttgttctatattagttgctttgatacaaaatgctgtacattagaatttaatgtgatctgcctgaagtccagatgaaaaaagattaaggcaaaagacaagaatgagaaagaattcctggtcaaaggagattgtttcattttggtggctgtccccatttgggctcccataaatgcactgccaggactatcgggggcagaaatattgagcctgggcagtcgactaaccacagcatcaccaacacgaatcatactcccattacccaacaaggaaatactgtctacgaaggggcccctagtgctctgcaccctcccgttcacttaccttcctgcttcacatttgaaaggcagtttagatgaaataatgcccgtttttcctaccaagtatattgtatgcaaccgtaaatcatcaaagaaccactgccccgacctagaacatatttggacatcactagaaataaaaaaaaggaatattagatcatgtgttggatttttttagggttaatataaaggcagatgtccaaagttagggatgctttcaatgctttcctatttccagttctcttgctcctacgttggctctgtgttttataaatcttctttttcataatgtagattcattgacctgctggatagtagattatatatatatatatatatatatatatagtacctaatagagttggctccttgccttgtatttatcaaagattcttcccccaactctcatcagtccttccccaaacaagaagtttaacaaaagagactagggacttctttagctcacttgtcgccaccatcccacaggacctgaatatgagtcctgtccaggagcagtggtgaactggaacagagcaaatatagtacccacagtgaatgacgaaagaggattggatcaggattgaaaactctaaataactgatgtagcttacacatttattactttggcttatcacagttatcccagaagatgtgaaataaaatcagagaaaagagaattttaaacagacattcacataataggccatacagacatgcagactgctgaccaggcacaaaattctggcaggcaggactgggagctagaggaaactggcattacttaagcaaggactgaacagtgtattcggaaaagaaaaaaatgagtggcctagggaaaagacaggctttgttctgaccaatcctttttgttcaccacacacccaaactgctagcagattcaaagtaattttactaaatacaacattcaccctgctttctgtattctattgatttacttaataaaaacaaacctgctttgtgattctagctacacagaactaaccagagaccccagtctttttagaagatatagagtgaattcagaatgtcaagtttctaaaacttaattgctatccataagatagaaaaatctcaattagaacttgaattcttaaaaattcatctatgatcacacagctatcagagaggaataaagataaaaaaaacactaacataacatgtagagggcaggaaagaaagcccatgtgttttcagtccagtaaatgatgaatgtgcaagaaagaggcatgaactaaaagagctttgacagaagaattttcttttttcaaagttaaaagaaagtttagttcccttttaaataacagaatcttctttttccagttgattttttttatttccaacttttattttaagttcaggggtacatgtgcaggatgtgcaggtttgttacataggtaaacatgtgccatgatggtttactgtacagattattccatcacctaggtattaggcacagcatctattagctattcttcctgatgttctccttcctctcatcccccaccctccaacaggtcccatgtatgttattctgcccctcgtgaccatgtgttctcatcattcagctcccacttataagtcagaacatgtggtatttggttttcagttcctgcattagtttgctaaggataatgacctccagctccatccatgttcatgcaaagaacatgatctcattcctttttaaggctgcatattattctgtggtatacatttaccacatcttccttatttagtctatccttggtaggcattgtattaatctgttctcatgctgcgaataaagacccaaggctgggtaattgataaaggaaagaggtttaattgactcacagttccacatggctggggaggcctcacaatcatggtcgaaggtgaatgaggagcaaagtcatgtcttacacggtggcaggcaagagagcttgtgcagggtaactcccatatataaaaccataaaatcttgtgagacttattcactaccatgaaaacagtatggcagaaactgcccccgtgattcaattatctccatctgtccctgcccttgacatgtggggattattacaattcaaggtgagatttgggtggcaacacaaccaaaccatctcaggcatttaggttgattccatgtctttgccgttgtgaatggtgctgcaatgaacacacacacgcatgtatctttataacagaataatttatattcctttaggtatatatccagtaatgggattgctgggccaaatggtatttctgctgctaggtctttgtaaaatcaccacactgtcttccacaatggttgaactaatttacactcccactaaccgtgtaaaagtgttcctttttcttcacaacctcaccagcatttgttttttgactttttagtaatagcctttatgactgacattagatggtatttcattgcggttttgatttgcatttctctaatcatcagtgatagtgagctctttttcatatgattgttggccacatgtatgtcttcctttgagaagtctctgttcatgttctttgcccactttttaatggagttgtttggttttctcttgtaaatttaagttctttatagatgctggatatcagccctttgtcagatggttagagtgcaaaaaactgtctcccactctgtaggttgtatttgctctgttgatagtatgttttgctgtgcagaagctgtttagtttaattagaccccatcggtcaatttttgctttttttgcaattgcttctagcatcttggtcatgaaactttgcccgtgcttatgtcctgaatggcattgcttaggttttcttctaggtttttatagttttggggattacatttaagtctttaatgcatcttgagttgacttttgtatacaatgtaaggaaaggatccagttttaattttctgcatatggctaaccagttctcccagcatcatttatcatatagggaatcttttccccattgcttgtttttgtcaggtttgtcaaagatcagatagttgtaggtgtgtggccttatttctgggttctctattgtattccattggtctatgtgtctgctcttgtactagtacaatgccattttggttactgtagcctttagtatagtttgaagttgggtaacattatgcctccagctttgttctttctgcttaggattgccttggttattttggctcttttctggttttatgaattttaaaatagtttttctgattctgtgaagtatgtcaatggtagtttaatgggagtagcactgaatctataaattgctttgggcagtatggccgttttcacgatattgattctatccacgagcatggaatgtttttccatttatttgtgtcatctctgatttcttttcaatggtttgtagttcttcttaaaaatatccttcatttctcttgttagctgttttcctaggtattttatcctttttgtggcaattgtgaatgggagttcatttgtgatttggctctcagcttgactgttgttggtgtataggaatgctagcaatttttgctcattgattttgtatcctatgactttgctgaagttgcttatcagcttaagaagcttcttggccgagacgatgggatattctagacataggatcatgtcatctgcaaacagatagtttgacttcctctcttcctatttgaatcctctttatttctttctcttgcctgattgcctgggccagaacttccaatactatgttgaatagtagtggtgagagagggcaaacttgacttgagccagttttcaaggggaatgcttccaggttttgcccattcactatggactgtgggtttgtcatgtgtggctcttattattttgaggtatgtaccttcaatatctagtttattgagagttttcaatatgaagggatgttaaattttatcaaaggccttttctgcatctattgagataatcatgtggtttttgtccttagatctgtttatgtgatgaattacatttattgttttgtgtatgttgaaccagcttgcatctcagagatgaagccaacttgattgtggtggataagctttttgatgtgctactggattcagtttgccagtgttttgttgaggatttttgcatcgatgttcatccaggatatggcctaaagttttccttttttgtcatatctctgccaggttttggtatcaggataatggtggcctcatagaataagttagggaggagtccctccttttcaattttttggaatagtttcagtcggagtggtaccagctattttctgtacctctgctagaattcagatgtgaattcatctggtcctgggctttttttttttttttttttggttggtaggttatttattactgtctcaatttcagaactctctattggtctattcagggattcaatttcttcctgattcagtcttgggagggcatatgtgccaggaatgtatccatttcctctttttttatggaaattttttttattattatacttcaagttttagggtacatgtgcacaatgtgcaagtttgttacatatgtatacatgtgccatgttggtgtgctgcacccattaactcatcatttaacattaggtatatctcctaatgctatccctctcccctcccccccacccaccccacaacaggtccaagtgtgtgatattccccttcctgtgtccatgtgttctcattgttcacttcccacctatgagtgagaacatgcggtgtttggttttttgtccttccgatagtttgctgagagtgatggtttccagcttcatgcatgtccctacaaagaacatgaactcgtcattttttatggctgcatagtattccatggtgtatatgtgccacattttcttaatccagtctatcattggtggacatttggcttggttccaagtctttgctattgtgaatagtgctgcagtaaacatatgtgtgcatgtgtctttatagcagcatgatttataatcctttgggtatatacccagtaatgcgatagctgggtgaaatggtttttctagttctagatccctgaggaatcaccacactgacttccaaaatggttgaactagtttacagtctcaccaacagagtaaaagtgatcctatttctccagatcctctccagcacctgttgtttcctgactttttaatgatcgccattctaactggtgtgagatgctatctcattgtggttttgatttgcatttctctgatggccagtgatgatgagcattttttcatgtgtcttttggctgcataaatgtcttattttgagaagtgtctgttcaggtccttcacccactttttgatggggttgtttgtttttttcttgtaaatttgttggagttcattgtagattctgcatattagccctttgtcagatgagtagattgcaaaaattttctcccattctgtaggctgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgactaggttttcttctagggtttttatggttttaggtctaacatttaagtctataatccatcttgaattaatttttgtataaggtgtaaggaagggatccagtttcagctttccacatatggctagccagttttcccagcaccatttattaaatagggaatcctttccccattgcttgtttttctcaggtttgtcaaagatcaaatggttgtagatatgcagcgttatttctgaggtgtctgttctgttccattggtctatatctctgttttggtaccagtatcatgctgttttggttactgtagccttgtagtatagtttgaagtcaggtagcgtgatgcctccagctttgttcttttggcttagcattgtcttggctatgtggggtcttttttggttccatatgaactttaaagtagttttttccaattctgtgaagaaagtcattggtagcttgatggggatggcattgaatctctaaattaccttgggcagtatggccattttcacaatattgattcttcctacccatgagcatggaatgttcttccatttgcttgtatcctcttttatttccttgagcagtggtttgtagttctccttgaagaggtccttcacatcccttgtaagttggattgctaggtattttattctctttgaagcaattgtgaatgggagttccctcatgatttggctctctgtttgtctgttattggtgtataagaatgcttctgatttttgcacattgattttgtatcctgagactttgctgaagttgcctatcagcttaaggagattttgggctgaggcgatggggttttctagatatacaatcatgtcctctgcaaacagggacaatttgacttcctcttttcctaattgaataccctttatttccttctcctgcctgattgccctggccagaacttccaacactatttttaataggagtggtgagagaggacatccccgtcttgtgccggttttcaaagggaatgcttccaggttttgcccattcaatatgatattggctgtgggtttgtcatagatagctcttattattttgaggtacatcccatcaatacctaatttattgagagtttttagcatgaagcattgttgaattttgtcaaaggccttttctgcatctattgagataattatatggttttttcattggttctgtttatatgctggattacatttattgttttgcatatgttgaaccagccttgcatcccaaggatgaagcccacttgatcatggtggataagctttttgatgtgctgctggattcggtttgccagtattttattgaggatttttgcagcaatgttcatcagggatattggtctaaaattctctttttttgttgtgtttctgccaggctttggtatcaggatgatgctggcctcataaaatgagttagggaggattccctctttttctattgataggaatagtttagaaggaaaggtaccagctcctccttctacctctggtagaattcagctgtgaatccatctggtcctggactttttttggttggtaagctattaattgttgcctcaatttcagagcctgttattggtctattcggagattcatctttttcctgatttagtcttgggagggtgtatgtgttgaggaatttatccatttcttctagattttctagtttatttgtgtagaggtgtttatagtatctctgatggtagtttatatttctgtgggatcggtggtgatatcccctttatcgttttttattgcatctatttgattcttctctcttttcttctttattagtcttgctagcgggctatcaattttgttgatcttttcaaaaaccagctcctggattcattgattttttgaagggttttttctgtctctatttccttcagttctgctctgatcttagttatttcttgtcttctgctagcttttgaatgtgtttgctcttgcttctctagttcttttaattgtgatattagggtatcaattttagatctttcctgctttctcttgtgggcattcagtgctataaatttccctctacacactgctttgaatgtgtcccaaagattctggtatgttgtgtctttgttctcgttggtttcaaagaacatctttatttctgccttcatttcgttatgtacccagtagtcattcaggagcaggttgttctgtttccatgtagttgagcagttctgagtgagtttcttaatcctgagttctagtttgattgctctgtggtctgagagacagtttgttatcatttctgttcttttacatttgctgacgagtgcttaacttccaagtatgtggtcagttttggaataagtgtggtgtggtgctgagaagaatgtatattctgttgatttgaggtggagagttctgtagatgcctattaggtccacttggtgcagagctgagttcaattcctgaatatccttgttaacattctgtcttgttgacctgtctaatgttgacagtggggtaacaaagtctcccattattattgtatgggagtttaagtctctttctaggtctctaaggacttgctttatgaatctgggtgctcctgtatttggtgcatatatatgtagaatagttagctctgcttgttgaattgatccctttagcattatgtaatggccttctttgtctcttttgatctttgttggtttaaagtctgttttatcagagagtaagattgcaacccctgccttcttttgttttccatttgcttggtagatcttcctccatccctttattttgagcctatgtgtgtctctgcacgtgagatgggtttcttgaatacagcacactgatggatcttgactctttatccaatttgccagtctgtgtcttttaattggagcacttagcccatttagaatgtatccatttcttctagattttctaacttatgtgtacaaaggtgtttacagtattctctgatggttgtttgtatgtctgtggggtcagtggtaatgttccccttatcatttctaattgtgtttatttgaatcttctctatgtttagtttattagtctagctatcagtctatctattttattaattttctccaggaaaagcagctcctggatttgttgatttttgaagggtttttcatgtctctgtctccttcaattcagctctgatgttggttatttttgctagctttcaggtttgtgtgctcttggttctctggttcttttaactgtgatgttaagttgttaactcgagatctttctagctttttgatgtgggtatttagtgctgtagatttctctcttgacactgctttatctacatcccacacatgctggtacattgtatctttgctctcattagtttcaaagaacttcttgatttctgcaatgatttcattatttacccaaaagtcatccagaagcaggttgttcagtttcagtgtagtcatatggttttctgtgaatttcttaattttgagttctaatttgattgtgctgtggtccaagagatgatttgttaggatttcagctcttttgcatttgctgaggagtgttttacttctgattatgtgatcaattttagagtaagttccatgtggtaatgagaagaatatgtattctgttgttttggggtggagagttctgtagttatctatcaggtcaacttgatccagagctgagttcaggccctgaatatctttgttaatgttctgcctcaatgatctgcctaatattgtcagtgaggtgttaaaatctctcactattattgtgtgggagtctaagtctctgttaaagtctgtaagaacttgctttatgcatctgggtgcccctgtattgggtgcatatatatttaagatagttggcacttattgaattgaaacctttgccattatgtaatgcccttttctgtccttttgatctttgttagtttaaactctatcttatcagaaacttggattgcaactcctgctttcttctgttctccatttgctcagtaaattttcctctatcccttcattttgagcctctgtgtgtctttgcatgttagatagctctcttgaagacagcgtacagatggatcttgattctttatctggtttgccattctgtgtcttttaattggggcatgtagctcatttacatttaaggttagtattgttaggtgtggatttgatcctgtcatcatgatgctagctgattatttttgcagactagtttatgtggttacttcatagtgtcactagtctgtgcacttccatatgtttttgtaatggctggtaacgatttttcctttccatatttagtgcttccttcatacgctcctgtaaggcagaggtttaacatcccactgacattattaggcagttcattgagacagcatttgcctgcctaagcatttgcctgtctgaaaaggatcttatttctccttcacttataatgcttagtttgtctggatatgaaattctgggctggaaattcttttcttttttttatttttattttttgtttttttgtttgtttgtttgtgttcagtacaaacttagggctctttaggcaataaagtaaggaacagcaaagtgggaggactacaccttcaccgtggcaacagaaagcctcaaaaatgtaaagtccctcaacttctattgggcagactcttcctagctcagaagaaacacattttaactggctgggaacaaggcctgccagcctggccacagtgtggaagggcagctggtcacacagcctctggtcaggcctggaagtgctcagagagaacttccagcagctcctgcttcttcagcccatatgcctctttcagcatgggcacagtgaaattgcccagcatgcccttgctgatattggccttcagctcctcttctgaatacttcatcttgggtcttttgcttccaaaatcttcattattttgttttctcttggtaaatttcccttcaggattgtaatctggtgggtaaacaagctccttaaactcaaccaccagggagtccaatcttttattcattgcttcaaccttgggcaatgtcaggtccactgcttgttcagtctccatcaaatccaaggccaaggcctccaggttcctgaagtgctgctgcagcccagggttctcaaagctgtcacttctgcatgtgaagcggagcttctgaacgatagccttcatcttgtccacctgctctggagttgccatgactttcagtaaagggcatcttccttttatcatcagcaaagagtaaaaagacaagctggaatcctggaggagtcaccagaaatttctggtcatccaactcctcttcctgtggcaccaaagccacaaaataaagagagatgttcctgcggggtgtgtatctgcgtgatgctacaacctccttgtccagacactttatgtgcagagcactaaacagggttgagctcccaatcaccagcaactcctcagggcacatgaacagggagggcctcagatgatggtgcttcttcagcattaccaagggcttacaccccatgagcatcaaacctggatcatcaaactgttttaactcttctgtttcccctttctccattataatctgagactcccatagatctcagacctcttggtatcactaggcagaagcaaacttcctgtatttgtattaaatgtctgggtcttggttttcactggttcatttgtttcccaatagagctttattggagaaggcttgagagccctctggaccagattataaatgcccagagatcactatatctttgatgagcttcagctttaacctgcttagtgcttgcttcctggtctccttggagtgaaccttctagtttgctggattcctcaaagtgaaccctgaggtcctcatcctctgctatgctggtgatatctctatagaataaggatatgtcaaagcccccaggtttcttcaggtgcttcaagtcaaggaagatacctgtatctcagagatcaccagctttggtcctggctcagctggcttaggcactgtcattgccatggggttgtcttcattggtgaacagcatgatcttgttatgactcatcatgaactggacatcactaaagaggttggcacagatacacagcacttcactgagtgagtcatcagatctgtggcccatcaggtcttggaaacgtttttgttcctgctgccccttaaactggtcaagctctagaatttattttgcacctggcttatccaactcctgtaagatgtaaatatttcactgaatctttgtctttctctgcactatagagcatcactgccaagagatctcaaacactgtttatgatcttactgatgtacacactttggatacactggatgctcatgtcaaagggagtcaactcatctttactctgagattcaaacatagccctggaggcatcaacaaaaaaaaaacaaactatctcttcctgaatacttatagtctccacttgcttcaaggttctcttcttgttcttctttgcttcttcatcggcctcagttttgtaatacgactcccacctttacatgttggctacttctcactttggtgtagggaagtgaccaacttggaccagaaattctttcctttaagaatgttgaatatagggccccaatctcttctggctgtagagtttcttctgagaggatcactgttattctcatgggcttccctttgtaggtgaccttgcctttctcttaacattatttgctgcccttaacattatttgtttcatttcgaccttagagatctgatgattatgtatcttggggataatcttttcatggagtatcttactggagttctctgcatttcctgaatttgaatgttggcctgtgttgccaggttgaggaagttctcctggatgatatcctgaagtatgttttccaaattggttccattctccctgtctctttcacgtaccccaatcagtcatagatttgatctctttacataatcacatagttcttggaggttttgttcattcctttacattcttttttatctattcttttctgccagtcttatttcagaaaaacagtcttcaagctctgaaattctttcttccacttgatctattctgctattaatacttgtgattgcattgtgaagttcttatactgtgtttttcagttctatcatgttcctctctaaacttgctattttggctgtcagcttctgcattgttttattatgatttttagattctttgtgttgggttaaaacatattcctttagctcagcgaagttcatttttatccacattctgaagcctacttctgtcatttcagcatctcagccttagccctgttttaagcccttgctgcagaagcactgtagtcatttagaagaaagggggcactctggttttttgagtttttgacatttttgagttgattctttctcatctttgtgggcttatctacctttgatctttgaggttgccaacctttggatggggttctcacagggattttttcttgttgttgttgttttctgtgttttttttgttgttgttgtttttctttgaacagtctgatggctgttgcatagggctgctgtggtttgctgggagtctgctccagaccctagttacctccgtttttcctgtacctggaggtatcaccaccgaagtctgcgaaatagcaaagatggcagcctgccccttcctctggaagctccatcccggggggtacggacctgttgccaggccaaatgcagttgtaagaggtacctgaagactttgtttgggaggtctcacccagtcagaagaaaagtgatctagtacctgcttaaagaagcagtctggctgctttttgatagagcagcatgcgtgttggggatctcttcagcctctgatcagattgagcaccccaaagcccacaagctggactggctaagatgcttgaacagccaaggtagtgacatgccccacccccagggcacttcatcccagggaaagatcagaactgttcataccgtatgtgcaggttgaggtagctggaggcccagctgggaggtctcacccaatgagggggaatggtttgaggtccagcttacagaagcaatctggccacattctggcaaagcagctatgctgcactggggaaactcttcctcatccagaccatttggactcttcaaagtccacaggctggaacagctgagtcaaccaaacagcagagatggcagcctgcccctcccctcagggccccatttcttctcaggcaggcacccttttactgcaggctggctggaattccaagccagtgggtcttgtcttgtgaggtgccatggaagtgggacccacaggccaatgctgcttggctccttgggttcagcccccttcctaggggtatgtacagacaccgtgcattgcctgggctgcagacacctttgttggggatcccaggactggagtatgtaaagctcctgggtctcagtgcatgcctgagcagcttctctgccaagactccacatagctctgtgtgtcggacccaaggccctggtggtgtgggctcataaggggatctcctgatccgcaggttgcaaagatctgtgggagaagcgtggtttcccagggtcgcacaatcactcactgcttcctttaactggatatgggggttcccttggccctgtgtcacacccaggtgggccatcgccctaccctgcttttctttcttctccatgagttgggttatttccctgaccaatcccactgtggatagctggataattcagttgaagttgctgtatccactcaccccagttcataaccaagccttatcacttgttaatctcctgagtaacacagaggtatctactttattctactttgaccaccacaaccttaggccaagcttgtctggctcatcttgtctgggctcctgcaccagccatcctatctattcttagtaacccagataactttttctatactcttacttcaactaaaaaaaaaaaaacttcatggaagtagcctagttacatttaaccaaattaaataaataacattttaaccaaaaccacataaatatatacatatatgcgtgtgtgtgtgtgcatgcgtgtgtgtgtgcttacattgcttcaaagataatgagctcttatgttgctatatttccctatattctttatagtaaatcctacaagatttacttactttttgctaccaacccccagtactaaataagctattcgtgggtctcactctgctagattctcatgtacaggagagtgtctgtgtcctaggtagtggtcatagatattgcttccaatgttgctgatttcagtaccataaagaagatatagcccagtaaatggaagagcaaagtagaatgaaatttttaatagctttgctctcttagtgctttgtctgtaagaatcactgttgcacttgacatttgttgccattttgctttttcattttgaattgtggagccagactgtgtctctatgttgaggggaggagaaggaatgacctcagaaatgtcagaattattactaatggcagcctttaagcttggataggtgggtaatagtgcttgaccaatctgcttaaatgctgactgtagagtagcgacctgaaacaatagtgggaagctatttaaaatttggaagaggcaaaatatgtgataggaaagatgtggcttattttcaagtacaggccacatggtatggtagcagcagatgccgtaaggaataagggcagcatctgagcagacctaaatgtaatctcacctctgtcattttcctacttgtgacactgggcagggtccacaatccctctgagccatcacctttcttgcatgtaaaatgaaatcataccactcactcaaggggctgttgaaaagattaatgacattgtgtatacaaaattccagccaccatagatgccagtttgcttttttctccctcgcttctgttttaacattgcagataatttacactaacaggtgatcaaggactaggcctaagccttcttctaagagactagcccagctcacagaccttgaagagacagtgtaattcactgcagagggctttctcccacttcttcctgctaaacaagttcctggagaggtttgaacaggcattagagatagtcggtggtacttgtccatatgcaatgctgtcagatgaatttttctatctgatgcagattggtccgaggccagcttcttgaccttaggttgcaagtggtgactaggagcagttgttcctgacaacttgtgttcttgcacatggctcataaccaaggataagacagcctccagaccatatatcctagaaataaatctagatatttctactcagactaatttttctctaaggggacagtgaagctcttctgggactgatccacctatctggcctcattccaggacaggcagaaggccttatgctgaatgcttactcaaggcctaagacagccaagacaaatagacttaacatgcttgacaactaatctactggtagtggctgcctagctagatatttgtagaattcccagtcctcttctgggcttagcataaattgtgtgcctcgatcagtgatgatgtctcccatagttactgcggagggttctcaaggcacacatgacagaattggaaacctcattatctggggatcctcaaagttccactttagttcaataaggatactggccattattcaagaactggtcttagtcacacacacaaaccatagtgtcatgactgagtaactcctcgagctgggtgaaaacaccatgaacacaataaacaaagacaatctcaattttttatcaatgcctcaaaagcttccagacccacaaataatttcaaatgtcaccagggatatatgttctgcatactacctagtccctcacaaccttgtgattctgggaactcagggactttcctggcgtcacttgaaatcactgaaagccaaggctagccctggtgcttttatcatcacttccagcagcctcccttaggtaggaaaacactggagtacaaaagaaaacaaaatatactgttcctaacacagaaatcccaggactttgaaatatttagactttttcagcccaaagcccacctgtcttctagcctgctgcctgagctattgatcttctgccaggtacatgtattcatgatcagtcaaagatgtcatcccatggagaatttaatgaaagaaatctacggaagggctccatctacccatctctacccatctattgtctttcctccttgtcaagaggagaagcaaggatgcacatctgtgcaaagagcaccaggtgttaaataaaatcattacctaaaaccaataccttcccatggactccaggatttcagtattagcacaggtgaactatagtttacaccaaacgaggattcctgaaaacacataactagccagaatcatgaaaagttataaaatatctttttattatgaccacattgagtacatattagagctgctcagacttttccatttggctattacataatctgaatgttgggtgatatttttattcttgctctcctcactcattaaaaactatgcagtgccattataaaaacaatattaataaaactagacagcttcccctctgtattttaaagcagtaaaaacattatttggcttctcatttacatggcagatccgattcatcatgttgacatagttaaacagaagaagaaatatttcacatagatagcagtgtcaaagcagtcagttctagaaagaaagtagtaatttaaaaaaaaaagaaaatatggaatcaatgaatggaatcataacaaagacattttcaatatcacatagaaaatcatgattatttgtaggtaaaacaaagtgaaaactaaagtgcacttatatttaaaattaaaaagattaaagaaactggtttcttgaaaagagcatcatatatttaaaaactaaaataaagagtgcaattaaaaataattcaaaacattttcagggacaaaaaaaggaaatatttaacatttattataatacctgagttttccttccttcatgaaaagagtactgaaaatcattttaaaaaaatttagttctaaataaaatagattcaatagtttttaaagatcactgaaaattgctttggaattgaagaaaataacattgaatgatttatagcttttaggagagatgggatacaagtcaatgacctgaagaaatggaaagaatgaagactcaggaaataaaacagaatgaaaaagataagaatattccacagagaagttagataatataagtgtagctttgggggctcagattaggaaaaacggcattagcttttgttttttgcaaaaactctaaaaggagcttaaaaatggtttatttttccacagtgcaggagtgataagacacagttttcagtgttttaagtgtctgtgtgtatgcatatatgtgtgtgcatgtgtatgcatacatatgttggtatgtaaccacacgtgtacatgcaaggatgtgactatggagactctaggtgctttgatcctctgtatcatatatctctcaagttaagaaaagggtattccccatcctgctcattggaaggtgcagctgaggtgatgttttcttctattattttcctttcggcttcttgctccaattcttctatctcctgcaggcgtttttccaataactcagcctgcctcttctgtttatttttcagttttttctttttgtttttagatatttttcctataggtttctgctgtggagccgtactcactgcagaccctgaaggaggaggaatacctgctttctgcccctcagtggtctcagctgccgttcttctcacatatgcatcatccatacacatcaagatgttttgcggctttatgtcagtatgagtaatcttggtcttactgtgtagatattctaacccttgaaggaaatgtcaaatgatactcttcagacaacgtactgggtgggaggccttgatagttgaacttgatgatccagttgaggagatggtggccaagtactcccaagaccatgcagacatgtatcccattcatgcctgaaatcttgaagtcaacgagctggatcaccatgtctttgtttgggtcactgggataactttctcgaacacatttgagcaattttatttcatccaaggctgtgtctgtatcacgctgagcactttttacaactttcattgcaacaaatcttttcccctacatatcccagcacagccagacagtagagaagtgcccccatccaagctttctaataacatgataccggccattgaagaggtctgcaattttcactggatgatagccacctttgcagtagtccgcagggtcctcttgctcatcatctgatccaggatctcctcctttggctctggtggtgtggggtctgccaaaggtggcggtggtggtggtggaggtggaggagaaagaactaaaggagctttctgttgaggctccagctttgtagggtgtttctctcttttcggcctccgcttttgggcctgaatgggcaacactttcctggagctcattccgacgcggcgcaagcggggctacaggggcttcgcggaggtgatggcgacgcgagcgcggaaaccagccgggctgcggctttcacttgctcaaccgaccgggaggaggctctggcggatggcgaatactgcgcagaagtgaaactaaaaacagcaggattagaggaggcggccgaggcagacggcaaaggacaatgctgaagctgaggaccaggaagagaaagaagaccctgagaaagaaaacattgagaaagaagatgatgtagatcaggaacttgcgaacatagaccctacgtggatagaatcacctaaaaccaatggccatcttgaaaatggcccattcttactggagcagcaactggacgatgaagaggataatgaagaagaccgcccaaatactgaggaatataatcttgatgagccaaatgcagaaagtgattacacatataacagctcctatgaacaattcaatagtgaattgccaaatgtatggcataaaattcccgagtcacagtttccagagttttccacctcgttgttttctggatccttagaacctgtggcctgcagctctgtgctttctgagggatcaccacttactgacagaagcaggacggtttcagcctccagtactggggatttgccaaaagcaaaaacccgggaggctgacttgttgatgaatcccctggatacacggaatgcagataaaattagagtagaaattgctgacctgggaaatgcttgttgggcgcataaacacttcacggaagacatccagatgagtcaataccgttccatagaggttttaataggagagggatacagcacccctgcggacatctggagcgcggcgtgtatggcatttgagctggcaatgggcgattatttgtttgaaccacattctggggaagactattccagagacgaagatcacatagcattgatcattgaactgctggggagagtccggtttactgaccgttttcttctggaaaaaaatacgctatgttggggaaatatttcgaggagtttttcaccagaaaaggagaactgcgacatcaccaagctgaaaccctggtgcccttttgatgtacttgtggagaagtatggctggccccatgaagatgctgcatagtttacagatttcctgatcccgatgttagaaatggttccagaaaaaacgatcctcagctggcgaatgccttcagcatccttggttgaattcttaccaaattctaccaatactgcattctgagctagcaagtgttcccagagcgttggacataaacggtgactctcattctttaacaggattacaagtgagctggcttcatcctcagacatttattttgctttgaagtactgttgtttgacattttgctttttgtgcactctgatcctggggaagagcagtcttttgacttcccttagtggtttactgaccgttttcttctggaaacaataacgtgtctctaagcattgtttcttgtgttgtgtgacatgcaaatgtcatttttttaatgagaaatactttcccctttgtgttttggcagggtttgtgactatctatttatgaaaaataaattttagctgagtactatattattgataaccttaagaaattatcaagttggaaccaagaaatagcaaggaaatatgcaatgttatcttctggcaaagggacatcattcctgtattatagtgtatgtaaacacacactgtaaatgttactttccattaaacatgggaggggggctcaaatttcagaaaagctaccaagtcttgagttctatgtagcatatgttgcatgtagccgactttaactgcttctaggagttgtgcaagcttttcattccataacagtcctttcacattggatttttaaaaaagtggctccgggttgtaagatatcattctctatgtggcactttaaaggaagaaaaaataggcttctcattctaaaatatgcataataatttagcagtcccatttgtatttttgcatatttttaaaagtatttttaaagaaaaagagggatttcactttaaaaatgtaaaggcttagtaccatgtcataatgcctcctctgggcactgtaacttaagctccacatagattaaattggaaaagagaaatgtgttcattgtgtcgaatgaaaaaatacatatattttcgaaaaagcatgatcatgcttgtctagaacacaaggtatggtatatacaatttgcagtgcagtgggcagaattctcctcacagctcaaaggtaacagtgatcatattcattccgtaggtagctttatgtgtggctacaacaaattttagcagcttttttattgtctttccatgaaatgaagttgagaaaatgattttccctttgcaagttgcacacagttttgtttatgcatttccttaaaattaattgtagaatccaagacacaaaccacaggtggcaatacaattttagaatgtaacatatagaggtatatttagcctgttttagaagtcagtggattcaatgtctttttactttaaattttacattaattaaggtgcctcattttttactttgtccattaacatttatccatatgcctttgcaataactagattgtgaaaagctaacaagtgttgtaacaataatccattgtttgaggtgtttgcggttgtcttaaaaattaaagtattggccaggcgcagtggctcacgcctctaatcccagcactttgggaggccgaggcgggtggatcacgaggtcaggagatcgagaccatcctgactaacacagtgaaaccccgtctctactaaaaatacaaaaaaaaaaaaaaattggccgggcttggtggcgggtgcctgtagacccagctactctggaggctgaggcaggagaatggcgtgaacgctggaggcagagcttgcagtgagccgagattgcgccactgcactccagactgggcgacagagcgagactccgtcttaaaaaaaaaaaaaaattaaactgttttgttttgctttgtttccagaaaaaaaaaaaaaaaagaaaagggtaaagagagtaaccatagggtctctatttttcgtattcaagaagcagtcagaacacccgaatgattaaaaacatgatctttagagtcatacgcatctgggttagaattctgacatttcactgctacatcatgtcatatcaggcaatttcattagtcttctcatgtctcaatttcttctttacgaattgaaaaatggtagcaacttcttcataagactgttttaaggattgaatgagatcatgtataaagccctcaacatagtgcctagcacagtgtataatcagtacatgatattcactgtaattattatttttactgataaatgtaccaagaatgaaactaaaaaaagacacaccagaaagtccagcaaaagaaaataggagataggaggagagaactgagaattgattgaccaatgtctgtcatagctcaaaagacttatgcaagaggaaccaaaagcctccactcatccatgactgctctcttctcagcaaggctgtgaccacacagtcaactcagaggatgggaatagtgaggttccacaataaatttcatactaaaacgcactgcccagtagcagaaacattagctgataatgatgaatccaatagcctagcgtttaaccgatacatttaaagcagcatatgacatatttttcataactacccttcactggcagtctaaaaacaaagaataaaaagcttctctttgatcaaaccatgttccaaaatgaaatagatccctttgttttatgtgtatgagtatatttacactgaaaatatatacatatattcacaaatacacgcacagagcaatgtagtacatgcagctgtgtaagaataaatggctttaaaacatatcagcaaatcaacaactgaatcattaaactgacaggaaaccttgttcaagattcccatgtcattttgcaaagagtgtactggatctgactagaatgcattaagagaccagggtgtttggagtttgaaaaacatctttaaaggaaaagaaagagaagtatgactgttagaaaaggaagcagatattctcaccagaataagaagtcaaattatgaacacttgagctttacaactgctttaaataaccctctatggtgaggcataagaactttaatgaaagcaaaaatcatttcatcatactgatggtatagagtatttctttttcttttcatggtttcttctttattcttagttcatttccttttttttttttccttgtgacctggtatttgcttctattataaactaagactatgctagcaaaagaaaatggaccaaggaggcatttatctgaataattcaggcagaaacaatttatacttgaagtagcaagaagttttagacaaaggagaatttttgcttggattaaccctcgacctggttcagcttcagactaaaataatgatgatacccgtggtgctgtaactttgattcagccagtgtactgaatagtcggccctgtgctttgggaccctgttgtgataatgccagcattttcatgcatgtgaatgcttacttttgaacaccgttactcagttcttatatcctgaaaaacttagtgagggaaaattgcatgcattcaacgtttataaaccctgataagctcagtttctaaacactggcatgagtgttgactggaagggctgtcatcggaggccctgccttatgagaacatcatgcctagtatttccataatctgccgatagactgcaagtgatggatctacagcaggatgaagacttctgaattagcattcaggcctttctcactgttgctcacagcagagacaggagagaaggggaaaaaaaaaaggattagatcttttctccttgcccctgtagttttcttctggcagtagactctgttgatgggaatgggcctgataatcgcaactacgcagaataggagagtggggtatgcctttgttggcatgtcctctgaaatgacctcggcaaagaatgctgtggaaaagaaatggtgattctaaagaaaaggcatttgtaactttttttaataaattttcctttaagttttggaatacatgtgctcaacgtgcaggtttgttatataggtatgcatgtgccatggtggtttgctgcacctatcaacccgtcatctaggctttaagcccagcatgcattagatatttgtcctaatgctctccctccccttgccgccacccggcgccccccgccccctgacatgcgcaggtgtgtgatgttcccctcccggggtccatgtgttctcattgttcaactctcacttatgagtgagaacatgcggtgtttggttttctgttcctgtgttagtttgcttttaaaatatttgaaagatgaaatattagaagaaaagaaaattgttttatggaaatgtttctccaataggcaaattaggttagaatgaagattaatgatatctaaccagagaaatcaactcagtggactccaccaaatcggctctcagtgcggctaaaacaaagcaggcagaaaaaggcagagaagcagcttgctgggtctacttgcaccagcaaccccttgcggggggtaggtggggctcccaggcctttggcctcagactgagggcggcactgtcagccccgttttttttcctttgtttgtttctgtttttgtttttgtttttgttttgagacagagtctagctctgttgcccaggctggagtgcagtggcgcgatctcggctcactgcaagctccgcctcccgagttcacgccattctcctgcctcagcccccccgaagtggctgggactacaggcactcgccaccacgcccagctaatttttttgtatttttagtagagacggggtttcgccgtgttagccaagatggtctcgatctcctgacctcgtgatccacccgcgtcggcctcccaaagtgcttggattacaggtgtgagccaccgcgcccagccccagccccctttctttgaggcttttggatgtggactgagccactccaggcttctcttcttcaccagcttgcagacgacctattgtgtgactttgccttataatcctgtgagccaagtctccctaataaactctattttgtatatatatatctatatctatatatagatatctatagatatctatatatatatctatatatagatatatataaatatctatagatatatatacatctatatatagagagatatataaactctattttgtatgtatatacacaaaatatatgcatatactaaatatatacactatatatgtacaatatacattgtacatatatacaatatatgtacatatatacaatatatacatattatattgtatattgtatatacatatatattgtatataatgtacaataagtacaatatatacaatatgtacgtatatatgtatatatgtacaatatgtacatatatatactatatatactatatatacaccatatatagtacatatatatacaacatatacatatacaatatatatacaaaataaactctattttatatatatatctatatctagatatatatagatatctatatatctatatctctctatctatatatctatatatctatatctctatatctatatatctatatatatctagatatctagatatatagatatatatagagagatatatattgtattgggtctgtccctctggaatgccctggttaatataaggacttttaaagaaatagatgtgcattagagatgagaaagaatggaaatcactaaatgaagccgtcttactgtttagctttggaaaagtagttcgagggaaaagttttagatttctcttctttagcacaacaaagatcatactgggaaaaccagactcaaagactgactgtttcagtcttattgaggtaacattgacaaacaaaaattgtatatattcaaggttataatgtgatgttttgatatatgtacacattatgaaatgactgacacactcaagctattaacacatccaggctgggtgcagtggctccgaactgtaatcccagcactttgggaggccaaagtgggtggatcacctgaggtcaagagtttgagaccagcctggccaacatggtgaaaccccatctctactaaaaatataaaaaaattagccagacctggtggtgtgcacctgtaatcccagctactcaggaggctgaggcaggagaattgctcgaactcagaaggcagaggttgcagttggccgagatcttgccactgcactccaacctgggtgacagagcgagactctgtctcaaaaaaaaaaaaaaaacaaaaacaaacaaacaaacaataaaagccattccctcacatagttaccattagtgtgtgtgtgtgatgagaacacttagtatctactttcttagcaaatttcaaatgaacaatattattaactgtagttaccatgctatacattaggtctccagaacttattcattttataactgcagaggggctgcaaacagctgaagtcagggcatgggatgcccttctgggggccaagcccaaggaagaatgtggcagaagaggaattcgggctttgggaagggagcagggcatggaacagttgaaggtagcagaagatgcctatggaatccctcctttaacttttcatatctccagtaaaattgccattttcaccacttgtggaaaatgatgaggaatcagtgatctgaccaatctagaatatctcagctatgctttattcaggaggcaaattaatttagaaaggaaattaataatacttaactttccaaaaaatataaatggaatccacataggaatttgaaacatagtcatgcattgcataaggacattttggttaatgacaaaccacatatacaatggtggttccatgatattatactgctatattttacttttctatgtttagataagttttgatacacaaatacttaccattgtgttccatctgcccacagtattcagtacagtaacttgctgcacatgcttgtagcctagaaggaatagcttataccatatagcctagatgtatagttggcaacaccatctagttttgtgtaagtacacttcatgttgcctacacagcgaaaagcacctgatgatgccattgtcagaaggtatccctgttgttaagcaatgcatgactagagcatatttgtatctgcaaactcaggacagagaactctgtggtgacatgtagtgcaaggaatttgctgaagtcttggggagtacttaggactaatattcattttgagccaagtattctaaacctctgagagataaggagatcccagtaacatctagggtatgtaaagctcatgcacaacagctgagatctcctcacagcagcacagctgaaagtgcaaatgcaggagcatccaactggactctcactgttcatgtcccctcctgcccaagcattagaatctagaactcacttcagtttttgagcattgtgttaccattgtgtgattttgtttttttaaatgaataagaaagacacaactctgccaaatggcattgtgaacagaagggttatttctcagagggtaaggagtgagtaagtccacatatgccctcagtcaagagagagtgaaaagaattttcaactcagaatttcatatccagccaaattaagcttcataagcaaaggagaaataaaatcctttacagacaagcaaatgctgagggatttcattaccaccaggcctgctcttcaagagctcctgaaagcactaaatacggaaaggaaaaactggtaccagccactgcaaaaacacaccaaaatatgaagatcaatgacactatgaagaaagtgcatcaactcatgtacaaaataactaaatagcatcataatgacaggatcaaattcacacataacaatactaaccttaaatgtaaaagacacagactggcaaattggataaggagttaagacaaatcagtgtattgtattcaagagacccatcctgtgtgcagacacacataggctcaaaataaagagatggaggaaaatttgccaagcagatggaaagcaaaaaagtggcagttgcaattgtagtctctgacaaaacagactttaaatcaacaaagaacaaaaaagacaaggaagggcattacataatggtaaagggaataattcaacaagaagagctaactattctaaatatacatgcacccaataaagaagcatccagattcacaaaacaagttcttagggacctacaaagagacttagactcccacactataatactgggagattttaacaccccactgtcagtatcagacagatcaaagagacagaaaattaacaaagacattcaggacttgaactcaactctggatcaaatggatctagtagacgtctgcagaattctctaccccaaaacaacagaatatacattcctctcagtaccacatggcacttattctaaaattgaccatataattggaagtaaaacattcctaagcaaatgtaaagaaactgaaatcataacagtatctcagaccacagtataatcaaattagaactcaggaataagaaactcactcaaaaccacacaattacatggaaactgaacaacctgctcctgaatgactcctgtgtaaataatgaaattaaggcagaaatcaagaagttctttgaaatgaacgagaacaaagaggcaatataccagaatctctgggttatggctaaagcagtgttaacagggaaatttatagcactaaatgcccacatcagaaagctagaaaaatctcaaattgacacctagacgtcacaattaaaagagctagcaaggcaagaacaaacaaaaccaaaagctagcagacaacaatcaataactaagatcagagaagaattgaaggagatagagacatgaaaaaccctccaaaaaatcaacgaattcaggagctggttttttgaaaaaaactaacaaaatagataaaccactagctagactaataaagaagagagagaagaatcaaatagacacaataaaaaatgataaagagatttcaccactgaccccaaagaaataaaaactaccatcagataatattataaacacctctacgcaaataaactagacaatctagaagaaatgataaattcctggatgcatacacactaccaagactaaaccaagaggaagttgaatccctgagtagaccaataacaagccctgaaattgaagcagtaattaatagcctaccaaccaaaaaaaccccaggaccagatggattcatagctgaattctaccagaaatataaaaaggagctgaaactactccaaacaattgaaaaggagggactcctccctaaatcattttatgaagccagtatcatgctgataccaaaacagggaagagacgcaacaaaaaaagaaaacttcaggcaaatatccctgatgaacatcaatgcaaaaatcctcaatgaaatactggcaaactgaatccagcagcacatcaaaaaacttatccaccaccatcaagttggcttcatccctgggatgcaaggctggttcaacatatgcaaatcaataaatataatccatcacataaacagaaccaaagacaaaaaccacatgattatctcaatagatgcagaaaaggcctttgataaaattcaacatcacttcatggtaaaaactctcaataaactaggtattgatggaatatatctcaaaataataggagctatttatgacagacctacagccaatatcctattgaatgggcaaaagctggaagcattccctttgaaaaccagcacaacacaaggatgccctctctcaccactcctattcaacatagtattggaagttctggccagggcaatcaggcaagagaaagaaataaagcatattcaaataggaagggaggaagtcaggttgtctctgtttgcagacaacatgattttatatttagaaaaccccatcgtcgcagcccaaaaactcaaacactccttgaactgataagcaacttcaacaaagtctcaggatacaaaactaatgtgcaaaaatcacaaccattcctatacaccaacaataggcaagcagagagccaaatcatgagtgaactcccattcacaatggctacaaagagaataaaatacctaggaatacagctaacaagggaggtgaaggacctcttcaaggagaactacaaaccactgctcaaggaaataagagaggacacaaacaaatgaaaaaacattccatccttatggataggaggaatcaatatcgtgaaaatggccatactaccaaaagtaatctatagattcaatgccattcccatcaaaccacaattgacattcttcacagaattagaaaaaaaactattttaaatttcatatggaatcaaacacctcgtatagtcaagacaatcttcagcaaaaagaacaaagcttgaggcatcacgctacctgacttcaaactatactacaaggctacagaaaccaaagcatcatagtcctggtaccaaaacagacatataggccaacggagcagaacagagacctcagaaataacaacacaaatctacaaccatctgatcttcgacaaacttgacaaaaacaagcaatggggaaaggatctcctcctattcaggaaatggtgcttggaaaacaggctagccatatgtagaaaactgaatctggacccatcccttacatcttatacaaaaattaactcaagatggtctaaagacttagatgtaaaattcaaaaccataaaaaccctagaagaaagcctaggcaataccattcaggacataggaatgggaaaagacttcatgaaaaaacagcaaaagcaattgcaacaaaagccaaaattgacaaatgagatctaattaaactaaagagctaatgtacagcaaaagaaactagcattagagtgaacaggcaacctacagattgggagaaaatttttgcaatctacccatctgacaagggtgtaatatccagaatttacaaggaatttaaacatatttacaagaaacaaacaaccccatcaaaaagcgggcaaaggatatgaacagacacttctcaaaagaagacatttatgcagccaacaaacacataaaaaaagttcaacatcaccgatcagcaaatcaaaaccacagtgagtcaccatctcacaccagtcagaatggtgattatcaaaaagtcaggaaacaatagatactggtgagggtgtggaggaataggaatgcttttaccctcttggtgtgaatgtaaattagttcaaccattgtagaagacagtgtggtgattcctcaatgatctagaatcagaaataccatttgacccagcaatcccattactgggtatatacccaaagtaatataagtcattctactataaagacacatgcacacatatgtttattgcagcactatttacaatagcaaagacatggaaacaaacaaaatgcccatcgatgatagactggataaagaaaatgtggtaaatatacaccatagaatgctatgcagccataaaaaggaatgagatcatgtcctttgcagggacatagatgaagctggaacccatcagcctcagcaaactaactcaggaacagaaaaccaaacaccccatgttctcactcataaatgtgagttgaacattgagaactcatggacacagagagggtaacaatacaccagggcctattgaggggtgggggtgaggcaaggaacttagaggatgggtcaataggtgcagcaaaccatcatggcacacgtatacctatgtaacaaaactgcacgttctgcacatgtatcccgtgtttgtttgtttggaagaaataaagaaaaaattttcaataaaagtttggggtttttaactctcaaaaaaaaaaaagaaaaggagagagagagagtgaaagccaagctaccctgccttgaaggggtcaattaggaagaaccaaactgaaagtaaccagcaatcctttattcattgttgtagtgcaggccaggatgaaggtgccagctcccacagtgttgcacatggccagggtggtctcacggccaaaggagctctgaaccaaaggctcctcctatcttatggacccagagaggaagaggaaaggactagtagtgaaaaaaatacaaaatacccattcaaagttaagaaaattttcttcaagtctcccccaataaggtgttctcagcagatgcacccaaagctaggggcagcccaattaggcggcctcggaatggaggcacttaaggtagaaatgcaaatacacgagacagggtcagctgtagagttgaggggagtgggggtcaggatctgagtccttgactgcacttcccttcagggatggcagagcactagctgatgtggggagggcagcttcccccatgagcctgccagataatgacttggaaacctcctatggtttgacatgaaaggtcacacataggatcttggcctggagccagacacctcatttcctggttgaaatttgtaatgctaaaattttaagttacgcagtcctacccaaatctgatatttttattttcacaacacagtttccttcattttcctaatggataaatggacggcttattttcatatgaattgatagtatcaacaaagagaaagaaacaaagagatcaggccaggcgcagtggctcacacctgtaatcccagcactttgggaggctgaggcgggcagatcacctgaggttcggagttcaagaccagcctgaccaacatgaagaaaccctgtctctactaaaaatgcaaaattagccgggcatggtggcacatgcctgtaatctcagctactcaggagactgatgcaggagaatcacttgaacccgagaggcagaggttgtggtgagtggagattatgccattgcactccagcctgggcaacaagaatgaaactccatctcaaaaaaaaaaaaaaaaagacacaaagagatcaaatacgggactttgcatttcagccaataataaaatatgtgcaataatttgctttgtttcaatcttctcattttcttcaggtgttttagaatactaagaggaatttttagtaaggaaatatgtagattagatgtttgaagagaatatattgatttgacaattctaaattttttttctgaagaatctgaccttttacaaaatcccaatgaagaccatactccactgaatcaaataatccttttcttatcaattactatgtcccctcagagaaggcaaaacataagtatgtaattttgctgctatgacagacagaagagtcttgctggaggccactggcaaacacattaatcactgaagcacctcaactcctcggaccctcaataaatacctctaccccctaagagagatttactgttgttgtgttctgttgttgtgtttttattattattattattattatactttaagttttagggtacatgtgcaacgtgcaggtttgttacatgtgtatacatgtgccatgttggtgtgctgctcccattaactcttcatttaacattaggtatatctcctaatgctatcattttcccctccccccaccccacaacaggccccagtgtgtgatgttccccttcctgtgtcctgtgttctcattgttcaattcccacctatgagtgagaacatgcggtgtttggttttttgtccttgtgatagtttgctgagaatgatggtttccagcttcatccatgtccctacaaagaacatgaactcatcattttttatggctgcatagtattccatggtgtatatgtgctacattttcttaatccagtctatcattggtggacatttggcttggttccaaatctttgctattgtgaatagtgctgcaataaacatacgtgtgcatgtgtctttatagcagcatgttttataatcctttgggtatatacccagtaatgggatggctgagtcaaatggtatttctagttctagatccctgaggaatcgccacactgacttccacaacggttgaactagtttacagtcccaccaacagtgtaaaagtgttcctatttctccacatcctctccagcatctgttgtttcctgactttttaatgatcgccattctaactggtgtgagatggtatctcattgtggttttgatttgcatttctttgatggccagtgatgatgagcattttttcatgtgtattttagctgcataaatgtcttcttttgagaagtgtctgttcatatcctttgcccagtttttgatggggctgtttgtttttttcttataaatttgtttgaggtcattgtagattctggatattagcccttttccagatgagtagattgcaaaaattttctcccattctgtaggttgcctgttcactctgatggtggtttcttttgctgtgcagaagctctttagctgttgtgtttttgttgctgctgtgttatactgttgtgtttttgttgttgcattatgctgttgtatttttgttgaacaggaggcatgcatgagcacagctgtctatgggtgggtccaaatgtgggagcttggtgtttggcttgcccctgtgaatagccccatcctgtctgcttaggccaatgctcccacctaacagagggactgttccccaggaaggtcagcagcctttcatgggagtacatgttggtttcaggtcaaatccatcccccagagaattgcaatatcatacacagagaatgtattgcagtgtctgaagagagttgcaccaaggactcagaatctgactcccaccccgtcaactggccatagtcttgtgcatgtcttcattcataccttacatgcctccattccaagtcctccatattaggctgcccttagccttgggtccatcttctgagatcaccttattaggaagcaatgaagaggtggcagaagctgcttaaactttacagcctcctccgagtaagagatcgccagtccctacattaagatgagcatgtaataccacatgccagacattaaccaatttatttataattcatttaaacataaattttgtgcatgagctaggtgttattattattatttatcttacttttagatgtggaaacaaagaggcagagagagggaaaaacttggccaaggaaacacatgtaataagtggtaacactgggatatggctccaagctgtctggacgttttaccaccatgccaaacccatctctcagtgaagccaggggactgaattcacacaggtgtttgatatcatccaatgcctccaatcagatgacttaacagaagacagatcctttctcaaaagcaccacagttacctacacaacaaaaagatttcatttaaaacctagcatcccatcctcctgccaagtctgggcccaaaacttagcatgaagtgaaggggcttacatctttttacaacaaagtgtgggatgagaagagatagaggaccacagttaaattgagaagatttcttcaaaattgcacactttaagtagattgatctttttcccttaaaaaaatggaattttaaaagatttacttacagctttgtgcacacttacatcctcctccagattcctctgttttatgacaaagacaacacaggacatagatggtttaggcatcttccctatggggactccagatagaagattcctattccacataactttatcctacttgtcaactatcagagtccaaaatctactaaatactgtaggagggtgggcatggccaagcatacacgtgctgaaactacatggttaattttaaatttgattaaagagcacatagaaaatcatttctgtatatttaatttacatgccatatacccactccccacatatgcacagctttccccaccatcagtatcccataccaaggggtttatggaaactctctgtactttctgctcaattttgctatgaccgtaaaactgttctaaaaaaataaaatgtttaattaataaaaattctgcatcagagtgttacatttattacaagtgtaatatattgaacatcatcattaccaaaagcccatcattttacattagggttcactctggcatttacattagggttcactcttgacactgtacattctatggatttggactaatgtataatgacctccatccatcattatagtatcatacagaatagtttcattgccctaaaaaatcccctgtcttccacctattcatctgttcctccctatagtccctgacaatcactgattcttttactatactcatatttttgccttttccagaatgttatgtagctgaaatcagtaagtagcctttttagactagctcctttcacttagtaatgtgcacttaagtttcctccatgtctttttactactcaactccaagatttggcataaaactacagtgataaaaggtgtgtggtactagcaaaagaatagacaaatagcacatcgctcaataggatagaatagagaacccagcaatagtcttcgtagctagtttctttttagaccgcatatttcattgtctagatataccacagtttatccattcacctgatgaaggacatcttggttgcttccaaattttggcaattatagataaagctgctataaacagccatgttcagatttttgtgcaaacatgttttaaactgttttgcatgaataccaaaaggcgtgattgctggatcatatggtaagaatatgtttagttttctaagaaactgccaaactgtcttccaaagcatctggaccattttgtattcccaccaggaataaattaaagtttctgttgaactcagaatcctcaacacatcctcaccagaatttggcgttgtcagcgtttttggaatttggccattctaataggtgtgtaatggtatcccatcgttgttttaatttgcaataccttagtgacatatgatgttgaacatcttgtatttgcctacttacctctgtatatcttgtttggtgagctgtgtattcagatctttgggccattttttaatagagttattcattttcttatagctgagttttaagagttatttgtatatttaggataacagtcctttatcagatgcctcttttgcatatgttttttcccagaatgtgacttatcttctccttctcttgaaactgtctcagagcagaactttttaattttaattaagttcagcttataaattatttctttcaaggaacatgtttttggtgttgtatttatttatttattatttaattttttagttttttgagacggaagctcgctctgtcgcccaggctggagtacaatgacgcgatctctgctcaatgcaacctccgcctcccaggctcagtgattctcctgcctcaatccccctagtagctagcattataggcatccatcaccctgtctggctaatttttgtatttttagtagagacagggtttcaccatattggccaggctggtctcgaactctttgccttaagtgatctgcccacctcggtctcccagagtgctgagaatacaggtgtgagccactatgccctgcctggtgttgtatttaaaaagatattgccatacccaagatcacctagattttttttttacatattcaaggaattttatagttttgtgttttacatttaagtctataatgcattttgaattaatttttaaggagtgtattcatatttttgcatatggatgtcctatttttccaggatcatttgttgaagactatctttgctccattatgctacctttgctcctttatcaaagatcagttgactatacttatgtggggctgtttctgggctctctattctgttccattgagctatttgtctatttctgtgccaataccactctctctattactgtattactttattactaaagctttatactaagtcttgaagtttggtagtaacagtctgccaacttttttcttctttacatagtgttggctattctaggacgtattgctctccatataaactgtagatttggttgtttggcatccacaagataactttctgggattttgattggaattttgttgaatctatagattaagttgggaaagactgacatggtgatgatattgagtctccctatccacaaacatgaggtgtgtcttctattatttagtcttttgatttctttagtcagagctttgtaattttcctcataaatatcttgtgcatattttgttagatttatacctaagtatttcattttatggggttctaatgtaaatggtattgtgtttttaattgcaaatgccacttattcattgctagtatataggaaagtgattgacttttgtatgttaactgcttatctgcaaccttggaataattgtttattatttccaggagttttatgggttttttttttttttttcagattttctacatagaagatcatgtcatctgtgaaaaaagacagtttcagttctctgttcctaatacctcttatttatttttgttgtcatattacattagctaagaatttaagtacaatgttgaatagaagtggtaagaggaatatccttgccttgttcttgatcttagcagaaaaacttataggctgtcatcaaatatgatgttagctgtaggttttttgtagatgttttttgccaagttgattttgtttccaagttaattgatttttgctctaatttttattatttcttttcttctacttactttggatttaaattgctcttctttttctagtttcctaaagttgaaacttagattattaattttagatctttcttttttctaatacttgtattcaattcctagtttcttctcacttctagtttgctgaaagtttgtaattataaatgggtattggattttgtcaaatgctttctgtgtgcctatgatcctgtgatttttcttctttagcatgctgatgtgatgaattacattagttgatattagaaaagtaaattagccttctataactgggataaatctcacttagtcatgatgcagaactctttttatacattgttgaattcaagttactaatattttgttgaagtttttgtgtctatggcctgcagttttcttctcttgtaatgtctttgtctggcttttgtattaggataatgctggcctcctaaaacgagttagatcacataccctctgcctctattttctggaacagattttagagaattttttttttttttgagatggagttttgctcttgttgtccaggatggagtgcaatggcgcaatctcggctcaccacaacctctgtctcccgggttcaagatattctcctgccttagcatcctgagtagctgagattacaggcatgcgccaccacacctagctaattttctatttttagtagagatgggtttctccatgttggtcaggctggtctcgaacccccgacctcaagtgatctgcccacctcggcctcccaaagtgctgggattacaggcgtgagcccctgcgtcagcactaaagaatttatatcatttcttccttaaatgtttggtaggattcaccagtgaacccatttgagcttggtgctttttgtttgggaagattaattatagattccgtttctttaatagatatagccctgtttaaattatctatttcttcttgtgtgaattttggcagacatgtctttcaaggaattgatctggtttatctaggtggtccaatttgtttacaatattattctattgtctttttgatgcctatggatgtgtagtgatgtcccctctttcagttttgatgttagtaatttgtgtcttctccctttttttcttagcctggctacaggtgtatcaatgttattgattttttttatttctattcaatagcttcctattaaacttatggtttgttgattttctctactgattttttccaatttcattgatttttgctctaatttttattgtttcttttcttctacttactttggatttaaattgctcttctttttctagtttcctaaagtaggagcttagattatttattttatatgttgcttttatctaatgtttgtattcaatgctatacagttctctttaagcagtgctttctctgcatatcacaaattttgttgttttatttttattttcatttagtttgaaatatttttaaaacttcctttgaggcttcttctttgactcatgttatttcgaaggatgttgcttaatctgtaagtatttggagattttccagctatctttccatgatttatttctagtttaatcccactgtggtctgagagcagacattgtatgatttgtatgctttaaattgtgttaagttgtgttttatggcccagaatttgttctttcctgctgaatgttccatgtgagcttgagaagaatgtatattctactgttgctggatgaaatagtcaatagatgtcaattatatccatctgttgatggttgtgttgagttcaactacgttcttactgattttctgcctgctggatctgtccatttctgaacagggacattgaagtctccaagtacaatagtggatttttctatttctctttgctcttctatcagtttttgcctcacatatgttgatgctctttccttaggcccatacacattaaggattattatgttttcctggggaagtgatccctttgtgattatgtaatgtcgaactttatccctgataattttccttcttctgaagttggctctgtcaataattattatagctatttcctatttcttttgattaatgttaacatggaatatttttttccaccccattactttttatctgtatgtgtttttacatttaaagagggtttcttatagacaacatgtagttgggtcttgttttcagatccactctgacaacctctgtcttttaattggtatacttagatcattggcatttaaagtaattactgatatagttggattaatgtctaccatattcattgctgttttctatttgttacctttgttctttgtttctatttttgtcttccacccttttcttccttttgtggttttaattgagcattttatataagtttattctcctttcttatcagatcaattatactttctttaacttttttttttagtgattgccctagactttgtaatatacattcacaacaatttcatgtccactttcaaataacactataccagttcccaggtagagtgagtgcctcataatagtaaaatagtcctagtttatcttcccatgccttgtatcactacttatttattttactcatacagaagcatatgtaaacatatataatcaaatatattattattatgaataagctattgtctattagatcagttaagaataagcaaaactaaaatgtttattttatcttcacttactccttctctgatgctctttctttctttatgtggatacaagtttctctaacctatattactttacagctctctaaagaatttcttgtcaacaaattatctcaattttttattttataataaaatctttatttcttcttcagtttaaagggataatttcacagggtgcagaattttaggttggtgaaggtcttttcttaacagtaaatacttctctctttttaattttactttaagttctgggatacatgtgcagaacttgcaagtttgttacacaggtataccatagtggtttgctgtacccatcaacctatcatctaggttttaagccctgcatgcattaagtatttgtcctaatgctctctccctccttggcctccacccccgacagaccccagtgtgtgatgttctcctccctgggtccctgtgttctcattgttcaactcccacttaggagtgagaacatgcagtgtttggttttctgttctgtgttagtttgctgaggatgatggcctccagcttcatccacatctctacaaaggacatgaactcactcttttttatggctgcatagtattccatggtgtctatgtgtcacattttctttatcctgtctattattgatggacatttgggttggttccaagtctttgctattgtaaatagtgctgcaataaacatatgtgtgtactgaacactaaatatttcacttctctctcttcttgctttcatggtttccaaggataagtcagttgtaattcttttctcctctgtaagtaaagtgttgtgttttttttctgcctctggtttttttcagaacttttttccttatctttgattttctgattttaagttatgaatctctgtatctacctgcttctcttctatgataggcctgtatgtagtttttttggcatttatcctgttcttggagcttcttggatctgtgggttgatatctgatattaatttaagaaactcttcagtcattgttactgcaagtattacttctgctcctttctctcttttttctccttctgctcttcttattacacatattttataccttttgtagttgtcccactgtttttaaataacctgttcttgttttttaaataactgttattgtttcttagtttttttatttgctttttcattttgaaggtttctgttgatatatgcgcaagctcagagattttcctcagctgtgtctagtctagtaatgagcccaacaaaagcatcctttatttcttatacaatgttttttatctctagcatttccttttacttttttcttagaattccatttctctgcttacattgtccttgtgttttgcatgctgaccaattttttcattaaaccccttagcatattaataatagttgtttcaaatttttattccagtaattccaacattcatgccatttctgagtctggctctgatacttcctttgtctcttcaaactaagaagtttgaagttctcttttagtatgccttgtaattgttttctgatagctggacgtaagtgcagagcagaaggaaacatgataaatgtgcctttaacgatgtggtggtaaggtgtagggggaagtgatgcattttacagccttgcgattaagtctcagtttttgagcctctgaattgtgaccttcacaaataagtcttagttttttgctctcccacttagatgagaaaggattagtaaagcaggctagagttgggtatttctctttccccaggtcattaggttctgataaaatcctaatagtttaggtcatgtttaaaataaaagtttctcttgagagcagggcttgttaagaacagaatgctctgacatatttcaaaacggtttcttttcccctagccctgctgagggcacaaggggatttttctctaatactcactgtgagaacttggtggagctcctgtaaataaaacttacaaaaatgtgtggggtcctcattttttaactttcaaatggtccactgtaagcctccaacaattcatcaattacggtccaaagttttctacccggtttaggtttctgttccattaagttgtgattctctgtacctacgtgcatatctccaattttgggagcagtggtttgccctgcaaccttacttctctgagtatctaagaagagttgttgatttttcagtttttctagcttttattgttggagcatggactgacgacttctaagctttttcccttccagaccagaaatgtaacctttaaaaacaaaattgctaactttaggcatctttaaaagtgaatatgttttgtgatttagctttttgccatctatttcaacccttcctatctgaagttttgtattagtccactagaacaatttttagttgtcttgcttcttagcttatatcagtctttcttacttttagagcaatgagttatgtatttatgtgttattctgtgttgtttattcaacaaacaggtttttaatgagaccttcttaccttttgttgaactgatttgagaggttccaaagaattattttcaatttttagcaaaagtttcttagacaaatgctgtgtgtcagcaatggactagatgcaaagttacaaagaaaaataaaataaagtaacagtacaataaaaattcaaaattttattgaacagtccaggcacggtgactcacgcctgtaaacccagcactttgggagtctgaggcgggtggattacctgagatcaggagttcgagaccgccctggccaacatggtgaaaccctgtctctactaaaaatgcaaaaaattagctgggcatggtggcaggtgcctgtaatcccagctactcaggaggctgaggcaggagaattgcttgaacctgggaggcggaggttacagtgagccgagatcatgccattgcactccagcctgggcaacaagagtgaaactccatctcgaaaaaaataataataataataaaataaaataaaacaaaacttgttgaacatcataagaggtccctcagaagaccaccaaaataatgtaatatagtattgctgataagctcaggatgagagatagtaaatagtagattctcccaaggagggagccatcacttctcactgataaaatctaaccattattgaacaactgatatgccacttttggataagtatgtttttagtgattaaaaagtacctaaggaagtgaagaaatattttttctggttcttgtaagttgagaaaaactagttaggtaatgtttcatttagaaatgcagaatagacacaacatagaattccagagaagatcgaggtgatctcaggaagccttcatgacagagcacctaggatagaccttgagcaacggccaggattcggagaggagaatttggtgagcaaaggtctgacattgggatgagcgtggcataacttttaattaggtttgggtttgaaaagaaagaaaatatatcttattaatatttctggttccatgttgagaggccacagtggaatggtataaaaaaaaacaaagtttctcaatatgattttggttggtttcaagacagagaaaatatatattaatacaagctctatattcaccttcccaattagagtgtggtgtgtagaaaaggctgtaaaaataatttatcttgaacatgttctttagttgaataggtgatagtttcagctgttggaatccacaactacccttcttcaatcagttgatctgaagcagcattaaaatgttctgataagctcccttggaaggatagtaagccaacatttactaaacatttaaaaacactgcccttccaaggggattatggaagcatttttatgctctctgatagcaaataagtatactcaataccaaatagatgtttagcaaataagcattgatagctctgtctttgtttgtaattgtccttttgttagctaatttgagcaacaatgaaaggatatgtcatacaggtactttcctcattcaagcccactgcctacatgcaggatgcaggtcacaattctctgttcaggccagttcttcctttcaactaacttatgtttcatgaagttattttctaatttattgaaaagtagtttctctgcccacaatgaaagtactttattttcctctgtgctccttatacaatagtgtagaaagagcatccaggtatgaaatgtatataaacaaagaattagcattccatacttgagttttcatctcttccacctggagcaccattagatgttgatgctcttggaatgaacctgcttgcacactcaccagcagcctctcatcaataggagagggacaggattgaggtaccctctctgcaggcttgcctgtctacccaaaagggaagtggtaaccaaaaagaaagggtgtggcatttgtttttcattccaccctctcatcaccaaagtccttccgcaccatttgctaatgtggtatttccaaaattttatccctttatgattgttaaatggctttgtccctttaattttctatcctttgaagactaccagatgtctgtagtttgctgcatctgagaatatctgaaagagagcaaggtgggagggtaccatgatgctggacccttctgaaggccaatgggcagaggcaagtatgatagttaatattgtcaacttgattggattgaaggatgcaaagtattgttcctgggtatgtctgtgagggtgttgccaagggacattaacatttgagtcagtgaactgggagaggcagacccaccgtcaatgtgggtgggcaccatccaatcaactgctagcacggctgcaataaagcagacagaaaaaggtgggagaaacttacttgctgagtcttctggccttcatctttctcctgtgctggatgtttcctgcctttgaacatcagactccaagttcttcagcttttggactcttggacttacaagagtgatttgccagggacactctggcctttggccacagactaaaggctgcactatcagcttctctacttttgaggttttgggactcagactggcttccttgctcctcagcttgcagacagcctattgtgggacttcacattgtgatcatgtgagtcaattctcgtaataaactccccttcatatatacacctatcctattagttgtgtccctctagagaaccctgactaatacagcaagtgtcgctgcgtggtggaaaaatcgagccagcttgacttcactattaactattaaaatgctacatctagttagccttttgaacagagacaaaattccttccatatttaccaattcacatggtaattttactatttctaagatgtagataaaaatccttcaaaagccacaagatatagtttcagccttaagaatgtggcttcttccctctttctccttcttttctcttcatcacactcttcatcctctttctcttcttccttgccttccccccgctttctctttttcatcttcacacaataaatactagctgaatgatgagactaaagtagggatgtcaggaaagaccctgctgaaaactatttgagaatccatgaccagtggaataaggcttaaactcctgctatttgtaggattagaattggtagcaatggcacaaacaacaaaactagggctgatgaagatgggtgacataggagatacaatagattcctaaggctgccttaattcattttagcaaggattagatatacttaatagttcctttttatacaaccatttaattactttcctgagtagaggtatctgtatgtattatataatgtaaaatctttccaaattagaaaaaaataataaacagaaataaaaaggaaaggaaggagcattgtcctttagacaatattatttcatagtcagatcctaacataggttaacatttcaaatgacatctgcaaaatctctttctaaatctgcttccatcatagtgttaaatacttcacattagcaccatgtggagaaaaaggcagacatttttaaaattgtcgtcttattaactgatgtgagaaaatgtttctgaatctaatgaagtatgaattagttatatccttatattttccaggctgtgattattagtaccctagtgaaatgctgaaatcacatgtttgaaaatacagatacaaacatatttctgaagaaaataaataaaccaaatcaggcttgttactctggttcaataataaattcaaatatgaagaacaggaactcttaaatataaagattagaaagaaaggtactctcatgtcaaaatctcagttgttttatttggtaaaaaaaaaatagttgtttaatttggtaacaaattatttaggtcattgtttattcacacagtcttctattagcttctcacaaacaaatagaagaaggtgatactccttcctctgagaatctgtcattaatttggaaaggtcagacacaccagcataaaagagttaaaaaatggcaatgagatttgttggtggtgataactagttctgtgggtcaatttcatgacctaaaaaataaagggatggggagggatcctttaactcaataggctttattccatctcaaaagtgtatatcagtataaaaaggtggtttaataagaggaaaataaattgtataattttttcacatagctatcgagagtggacagctctgtaccaagaagtgcagcatggttctaaatgtcactgaatcaacttctccagataaatgcagagacctacaaatttgtgcataaaaggttgagctcagggcaacttgctcacctcacctcccatccatgcttttccctctgggtcaaggctcctccatgtccgtacgttaaggagaaacactcaaatggctcagtggcctgcaaatagggtgtgaggactccaaaaaatgtgattgcactgtttcaaggagtagcagccactcagtttgagtggactgctgatatacagaatttaggtccaatttttcctctaattttttaagagaaatgaaaaacttgaatttttatgtgaaatcttccaaaatgaccttctaaaataatatttcccttttgacaaccatcataacattttaaggaaacaacatatgaaccaaatgaaatatatctataagctatgggctatgggctggacatagactaaggacaccagtgtgttatatttgttccagtgattcagtgtgaactggagaagtgaggggaagccggtgatgtttactgcagggtttgagctactccttgaatgtgtgtgtgtgtgtgtgcgtgcacacatatgcacatatgcacataactaactgtgtacacacaaggatatatataactgggaaggtaaaaatggaggccaatatccagaccctggaaatatccatgatcaaatggctggaatgataggaaagtatggaaagtttggtcatcacagtagaatgttttcctggctagaggagacagaagattgagtttgttgtaaaacagagccttgaaaggcagatgaagatgtttgtgctagcagaaaattcttaaacaatcttaattaattacatgttgatcatatataaagatgtgtgtctcccaggataccggacataaaataatactaccaatgaaaacccaggactccatataatagattaaatgaattgtatcaagacccaacaaacaatgacactttcaaaaatatttcttcctcctcacttattatcaatcataaatatgaatttcaaatcttagttgatttcagtggcaaaaatgctggagttttgattatttgtatagtgatcctgatgtaaatttctccagtaggcaagacagaaaattagggttgagctgaatgtcaattattcatgctaatttccattcatgtacaaatatctgatgaaactcatataatgaagctgggtccattttcacctttagtgaaaagaaaatatcactgaaaggatttgaaactaggaactgaaaattcaaaattatctttttcttgaacactcgaggaactcaagattttcacattacttttgttttggtttcacttgttcggtcttttgtttgtgttttgttgttattgtttatttattattatttgtgtttgtttgttgatattatcttcttggaatgaaaattccaaactagagagaagggaatgctacaaaatttaaattttcctcccagcctttaaaccagggcatagttcacctctccagaggcagcagctgctatcagttctttggataaacttccagaaatattacatacatataagtatcacttagacactgaattaagcacataaaagagcccaaatagaagtcacttagaaggtatagatttgtttttctctcatgtcgaagaggtctggaggcaggcacaccaagctagtaaatatcagagactcaggcacttttaatctttctttgtcattattctcaggatgtagtttttatccttaaagtcacctcatgagcacaacataattgctagagtgaaatctatcacatcaatattccaggcaagaagaaggaagaacaaaaggatatcactcccagcagtcagctccctttaaagagctttcttgaaaatcccacatcacatctaattgtttagccttttaggcttaagcctaaagtaggttttaaggttttaagtaggttttaagctggatactttgcaagtcccaaatacaggggttctgttggtaaagaataaaggaagaagggatattgaataggcaactagcaacccacaatatagaagcctacacgtatatgtattctcttccttcacattttttaaacaaatggtagcttactaacacagtcacattgcttttaactctatcctccacattcattagatttcagtggtaccaaaaccaaaggccaaaggccagggctgattcctctaaaagataggctctgccctccttcagctgctcataataacaattgcttcctgcactccttgctatgcaaagaggagcagtcacaaaccagcaacatcactgttacctaaaagcttccagagtctactagaaatgcagaatctcagctcttctccaagtctactgaatcagaatttgtagtttaacaagatctcaggtagtgtggatgaggatttcagtttgagaagcagtatgcacatttagcccttctaaggttccagattagtgacagcaaagcttgagagtctgttaggagccttctcccaactagcttttggggtctggaagtaattccatatcctaggcggggtatctgtgagaaccctagagtaaaccagcaccagtttgagcatcaagctgtaaacttactaatctatttctgattgtgccagtagtcagaagttctggtccttcttccctaatgtcgtgggctgggtccttcctcctatccccactccctctctgcaaaacttgaaggaaagtagcattcaactccagctaactccctggttttatcttcccttttcttacggagctgtccttgcttccagtttccttgactcttctcaaatgagcctcacttgtttctaatcattaaaaccaaaaactctgagaatttatcaccatcctgaagcctagatcctggctttttttttctttttttgcttcattgagtcaggacaacgttgatgtctcagtcaatttgagctgctacaacacagcaccatagactgagtggcttaaacaacagaaatgtatttgtcgcagttctggaggacaggaagtccaagatcagggtgccagcatagtcaggctcgggtgagggcccccctcttgattcacagatggatgccttctgtctgtaacctcacatggtagggaagagagacaaaaggagaccaggctctctcctgtctcttcttattggggcactagtctcatcatgggggctccaccctcatgacctaattaccttccaaaagcatcacctcctaataccagcatgttaaggattagagtttgaacatgtacattctgaggggacacaagcattcagttcataacacttggctatttacagtagctaggctaagggctgagtttgacaccctctcaaagtctcttttagagtcagtcctgcctcccagatctcaggcagattttttccaccgtaagtttataccaagccttgagcgtccctgatggttctcttttacccaagggtaaaatcagcctaatgcccaaaagaccatgctgctaatgtcaaggtgtaacttgttgctttgtcccaccattttttaagtccactgttagcacagcaagaactgcttctaggtgctggggccaggctgaaatgcagaggttggttaagtggctctagctgggatggagataggcaagcttagcagaacctaataattgcagtctagttgggtcctaatgtcaacactatgtgaatttggatggataaaaaggccattagatttgacaaaatgtaggctatttacctttaagagagcaatctcagcagaaaagtagggccagaaggcagattgcaatgaattaagcaaggaatgaaaaacagaggagaagaggcagctgataacattcatttctgacatctgtgggtagaaggaagaagctataagatgtaacagaatcaaattatatttttgtaagataagggagaactacacatttttgaagcagaagggaaagagtctgtgcaaaggacatactggagacaaactcaatagagcaacagaaaaatctttgagagtaaagataatgaaggaacactgcagaggggttgtctaaagaggaggaacttctcatatatagtaagaaagaatgaaggaataaatgtagacacaaaatacaatcaggtgtgtctgcacattggttcacctaaatagtcttacactcaacaaagtaatagaacaggcaatgttttttattacattgaggactttcatagaatcaaagatttgtattgtaagaaaagcttatggaaacaaatctgttggtgtaatttttttttttcatttaaagagatgggaaaccatgaatgaaaaaaataaactgatttgccaagactggtttaaagtaatctagtggccttcaggacttgacactatctaaagagtcccaatggggacatagacactctaagagtaagccctaatgagttaacctcacttcacttttggacatagttactaggctatgctgggattcaagtgtgctatgatccaaggtgctatggtttgttttgtccctgccaaaactcatgttgaaatttgttcctcaatatggcaatactgggaggtgactcccagtggaaggtgtttgagtcagtggggcagatccctcatgaatagactaatgctctcctttgggagtaagtgacttctcactctcatggtaatggattagtttctgagagaacaggttgttagagtctggtttccttggtttcattctccctccatgcgatcgatttgcacatgccagcttccctctgctttctgacacaagttgacgcagcctaagacccccaccagatgcagatgcccaactctgaacattccagccatcagaattgtaagccaaattaatatattttctttataaactacctagtctcaggtattctgttatagcaacacaaaacaagccaagacacatgcacctcaaggtgcaaattcaagtgcacctgaatttcatcaaagcatttagcaatcaattacactccaaaaataatgaatctcctggaccaaaaccagatgcaagcaactgaagggaaatatcatgttaatatagttctggggcttttccaaagacatctcagaactcttagtttgggcaataagaaaatgggaatcaaaggaaaaaaatcattatatcaaaaagacacaagcatgcatatttttatcacagcataattcacaattgcaaagatatgaaaccaacctaagtgtccatcaactgaagagtggataaagaaaattaggtatattcgcaccagggaatactacccagccacaaaaaagaatgaaataatgtcttctgcagcaacttggatggaacttgagaccattattcaaagtaattcaggagtgaaaaaccaaatatcatgtgttctcacttataagtgggagctaagctatgggtacacgaagggatacagagtggtatagtggatattggagactcagaagggaggagggtggaaagaggataaggtgatttttaaaaaactacatattgtctcaaactatgaaactactacaagaaaacattaggaaaactccccaggacatcagtctgggcaaaaatttcttgaacaataccccgcaagcacaggcaaacaaagcaaaaatggacaaatgggatcacataaagttaaaaaccttctccatagcaaatgaaacaatcaacaaggtgaagagatgatgtacagaatgggagaaaacatttgcaaattacccctctgtcaaggggtactaactagaatatataaggagctcaagcaactctataggaaaaactccaattatccagttagaaaatgggcaaaagatctgaatagatatttcttaaaagaaaacatacaaacgggaaatagacatatgaaaaagtgttcaacatcattgatcatcagagaaatgcaaatcaaaactacagtggaatatcatctcaatccagttaaaatggcttatatccaaaagaatagtaataacaaatgctggcaagtatttggagaaaagggaacccttgtatactgttgatgggaatgtaaattagtacagcaactatggagaacagtttggaggtttctcaaaaaactgaaaagagagcttccatacaatccagcaatcgcactgctgggtaaatattcaaaagaaaggaaattggtatatcatagagatatctgcactgccatgtttgtttcagcactgtttacaataggcaaaatttggaagcaacataaatgtccatcaacaaatgaatggataaagaaaatgtggtacatatacacaatggagtactgttcagccataaaaaaagaatgagatcctgagatcttgtcatttgcaacaacatggatggaactggaggacattattctaagtgaaataagccaggcacagaaagacaaacatcatatgttctcacctatatgtgggatctaaaaatcaaactcatggagatagacagtagaaggatggttaccagaggctgggaagggtagcgggaggggttagaggagctggggatggttaataggtataaaaaaagaagttacaaagaatgaataagacctagtatttgatagcataacagggtgactatagtctataataacttaattgtacattttaaataactaaaacagtataatttggattgtttgtaacacaaaggataaaatgcttgaagggatggataccccattttacatgatgggattattatgcattccatgcctgtatcaaaacatctcatgtaccccacaaatacatacaccttcaatatacccacaaagagatataaaataatttttaaaattacatattgggtacaatgtacactactcaggtgacaggtacactaaaatttcagacttcactattatgcgattcatccatgtaaccaaaaccacttatacccctaaagctactgaaattaaaaaaaaaagaaataaagaaaatgggtaccattcatgaaaaaaagttctgatttctattgatttgaacatattattatgaaaaattgatggttgttgctcactgaattgaaaaagttacaataaggccaaacgtaaagtctaagaactctagattattagacacaagcatcctggagctatgttgttcttttgactcatatcttgtattcttgtgctgcagaaaaatgcttttaaaagcttaagccaccatttaaaaagtacatagcatatagtgagcaacgtgtggaggtggatagcacttaattctaagaaaggattactctgaagaattacaccatcatcctggggattacagtataaaagaccttgccactactttgctaagtaaatgcagctttggattgtgaaaggagaactgcatattgatcagcagtaagcagagaggttaacatcatgggctccaaagccagagtgtccctacctaagtggtttggggacatgttaattaaactctgtgcctcaattttctcatacatagaataaaatcaacaatacaacttagcacttggagatagaaggacttagtgaattaatgaacatacagtgttcaaaatagtatccaactaaaccctgtgctaagcactagatatccattatcttgataatcttcacaataattggtgaagtagtatgattatatctatttgacagattacaaactgaggctcagtgaggttaaataccttacccaaggctcactctaatagtagtggcaaaggtaaaagttaaactgagatctctctgaccacaaagatggactcttgaccaccataaccatcaactgtgaggtgagtgttggaacccaggaacaaggctgaaacccatcctgagacctgggtatatcagagcaacgctgttggcaagagtggcctcatgttgatcccccaactgtcagatggaaccccttgaatccctgccacccaagaacagtaatggtcctgagaatagaggtgaattatttccagcggtcaggagagaaaagacacaaaatctcagatccaaggaggatgtaggagcacaatacaggaaaagtggtgatactcagtgtccattttgccaagaccataggggaggcccagtagtcaatgacatgagatcctctcccacccttgatcatggagtggatggtctgtgatctgttgcagcaatgacggaggatgagcagatccttggttacacaatgggcttcactcaaaggtctatcagtaacaaaagatggtactgaactgggagcagtggtgtgggcctccaatatgagctacttcccacatgggaagctgaggcaggagggtcacttgagtccaggagttcaaggttagcctggaaaacacagcaaaacactctatcttaagaaaaaagaagagagagagagtgagaaagctgatactgtggccagtttctcacacataacaccctggggccttctcagagctgggcctacagcatcatcagcctaattttgactcttgtgcaaggcagtggaattaggtgtcatgcactccatctgctgattcagccatacatatcacagcatctgccacatttcactaggtaggacttttacgtacgtcccgcaagttaggaaggccatgaaacaccattcaattacagaaaagcaggattccctactacgaaacatcccctctcaacttccacagacacatatggatagaggaatgcctgtctttctcttacattctcctgagaactataaactccatatttctacatgtggctttatctgcatcgaggggctgaacagtctactgagtttaccatgactcactggatggcaggagcagcacctgcaacagaaagagctccagacattgccatttgtaaaaacataccctcaatggctccttattggctaagtcagctgctcagtgagaagcagacaggcagggggtggacatgtcagtctgtatgcccagagggtggtgcctgactgcctaagcatggggatcagagcacagctgctctgccatccactgcctcccagtggctgctctggggacctcagctctcaatgcatacaacctggagatgaacacctactgctgggttatgtggttctgtggaaatctgtatttgaggatccattggcacaaatatgcttcctgaaatactgagggtgccccaaaatgaaaggggcacaaaaagagtccaaatgctctagtaagccagaaaccagattcaaaatgagtggtaagaacaagggttttaagtagctagaggttgaagtcaatagctcaagatgggaatgtgggacagaggttgaataagcaagtctgaggtcagcctgaatagatacaggccaagagctcctgcccaagcccaacttttactccagtttcttgggtctgactgcatttaaatgatcaggcatggaggaggcagagctcagtgtaacctagataatttataagtccccatagccacaaagacatgtatactcaacccaacccaagaccttgcctgtcacattctgacaagacaaaaaccactctctatcctcaaaatatactcgtagtcatgtgacacatttatgaattctcttttagtttacattttggattgtaaacgggtaaatattagatggaacttttccttgatagaagtatttttcttcaaatgacctcataacactcagatataatgatcctatcaaactagccacataataccattgaagaattattgaatttggcaatgtacacttagaaaagtcctacatgaaatgatctacttaaataggcccctttacaaaaaaatcttaggcaatgttcttattccttaatgacttgctaccagaaatgcattatcttagaacaaggttctttgtgagtcagggtaacatcgatgtcctccatgatattgctgagctggtgtgtgcagagtgtctgcatcacagaagtatgtcactgaaagtcttatctttcttggtagaggccagcgaatcatttgtttttcattttgaaactgtctccacaagtgcttcccatacacataagggcagtaaatccccagagcttgaataaatgtgatgctgtttctgttgtgcatttttatggtcatcgtggagaaaacaacttatttccatattcattgattcatttggagtccagggtgccagtgggactcttagaagagtgaaccaaatttcttcacataatttcaggcttcacttggcataagacacttccatagaagatgcagctctaattctggattcctgaaggaacagtaggagcagcttgattaaaaacaaacagattaggtattactgggagtcacactctccccagagtgatccaaataaataagaggaccgtctctcctaagacttcttcccctgaggatcctaagagcctagacttctgttctgctgggcgcacaagatagcacagataggcctgggtgacagttgcactaaaaggccctctcgggagccatagaaaaagaaatgtggccacaaagcatggggagatgaaactgtccacctgctgcctcttcttcagtctcagagtttcttgataagccctctagaataaggaaggataaatatgctgcctgtattaatctgttctcacgctgctatgaagaaatacccaagactgggtaatttataaaggaaagtggtttaattgactcacagttcatcatggttggggcagactcaggaaacttacaatcatggcagaaggcaccttttcacagggtggcgggagagagaatgagtgccaagagaagggggaagtccctgataaaaccacaagatctcacgggaactcactcactatcatgagaatggcatgggggaaaccacccccatgattcaattatctctacctggtcccacctttgacacatggggattattacaattcaaggtgagatttgggtggggaaacagagccaaaccatattgctgtccaatccactgagggtgaacccttggacaaagctgagccctcaaccccttagaagatggacttgaaagtttcccaaattagtagccacatgttatgtatctggacattccgttgtttatcatcctgacttaggacaagagggtatgctgaattcaggcttgctatgagggttggaacactgcctgcctgatgaaaactgctgtatcagttcaacagggtgactggaaaagtcttatcctatcatattatttctctctccccagtgaaggaagcagtatgcattctgaaatatccatagcatttttgatatctttcaagtgtttggtttcatgtaaaatcaaccaaagttaacccataaatgaaaagactctactatcctttttctttccacatgtttatacttcatccatctgttgaagatggtattatataatcattggcttgttctcatctttagtgcatgatccacacaatatcaaagcaaggcagcaaaaatctggagaacttattgaatcatggcaataactctgatgcacacaagcagagctggagtttacagtggctgagcaacatggtgacccacaagggaacttcagaattgctaccatgctggagttctgaaattcatccactgtatttcagacaccctggttttcctcccttacctcactttgcaatgcaattcttctcatttattcattcagaagcatttgatgaaacattcttcttagcaggcagtgctaagtgttagaaatgcaaagttgaattgagaaaaagctctcatcctgaaagagcttcatagtagagacaaacatgtaaataagtataatcaccatgcgaaatgtgccttattcaaggagtatgatgatgtgtcaaagtagaggaagaagcagattctctccctgatggagctggggcaggactctcagaggacacgatctttgcatcaggtctctcggagggtagttcctgccttccaggacctacttagaagataacgaatggacacaatgctgtgatacaaagcagtaccttgaagctgccattacagatataagaacaaagtgcagagactgttcagactagagatggatcaactaaaaaaatcaaagaaagtgacatttacaactgggcttaaagaatgagagggtttgtgcatgcagagatgtgagaacagggtgagggggtcatgggaaagcaaagaatggggtgtactcagggagttggagtacagatgcatggcagaggagagtggaagataagccttggagccaggctgaagcaggatcataaagggactggaagtggatagcaagtgcatatgcatttgcaccagtgaaacaatctttgttactgagtacctacctcaaattgtgaataaagatttaagaagatgtgtattgccatcaaaattcaaacatgctataattgctataaaactcacctttaagaaaataaagaaacctcactgatttcatatttttctccagcgactatcctttttctcctcctctttcagtaaaactccttgaaagaactgttaatattctattttctcttgaacctgctctgatcggatttttgcccttctctccaccaaaatgaccataattaagaccactgatgtcttccactggtccagtccagtgttcaacgctcactcattgttcttaaccaatcagagacctttaacacagccaatagcctcaatttctgtacccctcatacttctctggtcagtcctttttggtctcttttgctggtttctagtcttctctccaattgctgaatgttgtgatgctccagaacttcatccatggaccccttctctgacttcactcacttccttagtcacatggctttaaataccatctacagatattctattaacctctacatgtgtcattgctctttacctgagaatttctcagcgttgtgctttcatcaagcaaccttcgtgcatgaggtaacttcttccccatctcacccccacagaaagtaggctggcttcaccttactgtgaaaacagcacagaatttccttccagtaacacaacccacaagtgtgcgagcatccatcaaggcccaagaggcatgataaatggagaaaagagatatgaaacttgtgttgccctctgcactgtgaataaaagtcctctgtttctgacccagcacccatggaacagtaatagactaatttgttaatttataagtagggtaaaatccctgcaaagtttctgacattaagtagctatgctttctcttagaagttacttaataccttaactgaaatacgttacatatagaagctttctattcacaaatgttcaacttaatgactttcattagaataaagctctgcacagagcagtgtgtcagtctctgtctgcctcccataggcagacttggtgaaggatttcagagagtcattttgaacttgaggataaaataactaacaagcagtattgtagaacctgtgtgatatggtttggctgtgtccccacccaaatctcatcttgaattgtagctccaataattctcacatgtcatgggagggacctgatgggagacaactgaatcatgggagtgggacttttccatgctgttcttgtgatagtgaataagtctcatgagatctgctggttttataaaggggagtttccctgcacatgatttcttgcatgccaccatgtaagacatgattttactcatcatttgccttctgccattattgtgaggcctccccagccatgtgcaactgtgagtcaattaaacctctttcctttataaattgcccagtattgggttgtatgtctttattagcagtgtgagaacagactaatacagtaaattggtgccaggagtggagtattgctgtaaagatacccaaagatgtataatcaactttgaaactaggtaacaggcagagagtggaacagttcgaagggctcagaagacaggaaggtgtgaaaaagtttggaactccctagagacttattgaataactttgttcaaaatgctgatagtgatatggacaatgaagtcctggttgagtagtctcagatagagatgaggaacttgttggaaagtaaaataaaggtgactcttgctatgtttagcaggtggcattttgcccctgccctagagatctgtagatctttgaacttgagagagataatttagggtatcagacggaagaaatttctaagcaacaaagcatttaagaggtgatttggtgctgctaagtattaatatattaatgtatttatgtattaataaagatatggtttggaattggaacttatgtttaaaagggaagcagagcattaaagttcagaaaatgtgcaggctgatgatgcaattcaaaagcaaaacccattttctgaggagaaattcaagctggctgcagaaatttgtatagaagccaaatgttaattgctggaacaatggggaaaatatctccagggcatttcagaggtcttcatggcagcgccccccataacaagctggtaggcctaggaggaaaaaatggtttcatgggctgggcccaggaccttgctgctttgtacagtccggagacttggtgccctgcatcccagttgtggctaaaaggggccaatgtacagctcaggctgttgtttcagagggtgcaagcccctagccttggcagcatacacgtggtattgggcttgcagaggcacagaaattaagaactgaggtttgagaacctccacctagatttcagaggatgtatggaaatacctggatgtccaggcagaggtgtgctgcaggagcacagccctcaaggagaatctctgctagtgcagtgcacaagggaaatgtgcagtgggaatccccacacagagtcaccactggggcaatgcctagtggagctgtgagatgagggccactgtccttcagaccccagaatggtagatccactgacagcttgtaccatggacctggaaaagccacagacactcattgccagtctatgaaagcagccaggatgggggtgataccctgcaaagccacagctgtgtagctgctcaagaccatgggaaccccctcccttgcatcagtgtgacccggatgtgagacatggagtcaaaggagatcattttggcgcttactgccctgctggattttggacttccaaggggcctgtagctcctttgtttggccagtttctcccatttgcaataggtgtatttacccaatgcctgtacccccattgtatcttggaagtaattaacatgcttttgattttacaggctcataggtggaagggacttgctttatctcagatgagactttggactctggatttttgagttaatgctgaaatgtgttaagactttgggggacagttgggaaggcatgattcattttgaaatgtgaggacatgagatttggtaggggccaggagtggaatgttatggtttggctgtgtccccacccaaatctcatcttgaattatagctcctataattcccacgtcatgggagggacccagtgggaggtagttgaatcttggctgtgggtttttcccatgctgttctcatgatagtgaataagtctcacaatatctgatggttttataaaggggagttcccctgcacacactctcttgcctcccaccatgtaagacatgacttttccccacctttgccttctgccatgattgtgaggcctcctcagccatggagctgtgagtccattaaacctctttcctttataaattacccagtcttaggtatgtctttattagaagcatgagaacagactaatataccatatataaaatagagaaacatctatcattccttaaggattcttttaagctttaaggcttcaatgttggtgtgaatgtggggaaacttaggagagtgactggggagttatgttgttcaaggattcttctgcctttcttcaagcccagcaatcctctcattgaatgcctctcttctctgagttccctggaggaccttttttaatccctctatttcacataacagtggtcactaaagacacatgatttcagggatgactcaattttttaattcattcttaataagattcacaactagcaggacacacagcaaatggttatcctcctagtacctacaggtgtgaaacctaatctagtcaattcttatacaaggcctgcaggtcaaaacaaaccaatcccacatacaaatcctatttgcaaaaactaatcaatctcttaacaaaaagtggagttagaatgtagctttatgtcatttgcattaattaaatatatcaaagaagatggaatgtatgctatcagaatttacaatatagagaagaaagtcattttaaattatataactacagaaatggatacctttagtgaaagacaaaagttgtctttaaaatgaatgactctttccaaattttattaaaagcagagataatcaagactgttgtgctgatgttatttactttgcctgtgtttgttattggcaagaatgcattttccatttcttgtagacaagcagaaagccacagagactatttaaattcaaattctgggaaatcaagaactacacaacagtcagccatctacaaattgatgatcaacatgatgtctagacagtttctcatgagggcaacattattaattaagcagcagtttggttaatcacaatagcaaaagtaatttttggagtaaatatttcatgagtatgcccatcaataaggcaaaagtaaaaggaaatgttttaattaattcatttataataatatagagattatggttggcaaattctgtttgaggacttgaagaatgatttaatatttctagtatggcatgtcattgtcttattgttttcagctaatggtactgtctatctccattgcctggccaaaaattctttcatgtcatctatcaagacaatattaaggtccattagtgaatagttagatctgacaaattttttcttgctatacattgttctgttcttttaaaactgtgcattcctacatttatcagtaagaaaatattcactggatagggagacataacatgcttccatgttaagaaactaaccttactttctgtccatcaaaagacttgttatttggaaaaggaaaaataaataaattgaccagttctctttagcacatagacaatgaatcttttcagaaaatgcagttaaaccaatatttttataataatccatggtcttaaaattataagaaagaaatataagttacatagaacttaagtaaacacatatttctgaaaaaattatccaaagagcttactctcttttgccttcataaaagttcatctataaccatcttcacatacatagcttgcttcatgtctcatcctactcccaaacctctctttgaatttcaactgtatttacttgaaggataaaatgaagactaaaaagcttgcatttatttttcaatgttagtcatctggtcaacatcttcatttttagcctagaagaaagtgtgcattaaaatcacataaaaatttcctgcaacaagtacaattttattttatattatacagatttcttagagggtatttagatttttatccttaaatatatgaatatgtataacaaaataatatatggttcaactactaacagttaatactttccagtcctcttacaacagtggaaagataatttagtagagggtggtatacacttagtttcaggtcaagattcttccatcgggacaggatttttttttttttcaagggaaattggtctcctgttggatttccaggctcaactccatcaaattaactctacatattgatatgtgaaaacaatgtatcagcatgactgagtttgttctcaagagacgttctcatcaatcctcaggcctttcttccagtaaatgccaatggatgaaccagtaaatgctgatggaccaaccaataaatgctgatggactccagcatgacaaattgaatgagccaatattagaaaacaccaaaatacgtatttcctgtcaaagaggctaacaatatgttaacgtatactttaggcatcattctcatattgaaaaacatcaaaaaagacaaaataataattcgctttaagtcaatataaaggtgtgggtagaagtattatattttttccaaaaaagagggaggcaatgtattagaacattagaaaataatattcgttgtggcattaagctatcatgaagactttagctttacactggaaaagtcccatagtactcaatcaaaacattttgatatatctttgcttacctctcacctatatgcatgaaaaaataatgatttgtgggatttaacttacctgagtttgttgtggaggaataatcattggaatacaaaaactatcaagcaactatgggcttacgatccaataagcaacttccaagatagaattcgcaatgcatcatctaaatttctgtctataggcaaaacaacagaactcctcgttcggaaattttccattgcagcctgattcctccattctgttactatccttctccttccttgcagtgacactgaaagaaaatccagagtgtcagtcattttagtcacagtttataggaagagactcttgatctgcctggctgctgcttggtctagctctttaggtttcaaaagaaatctggtttatccatgtttatgacactagaactcatgttgcccaaacttactgaactatttttcaagctaaaggatcatctttgaagtaagttctccaaagtaatgaattcaaagaggtatacaaagtaacaacagaaaatgcatgtatcaaaaggtgtacacaggataatccgtggaagcatgggaagttgcagcttctttttctatttattttttatctaaaaacctaaggaacattagcttgtaacaatatctgacttatagtttaacactggtagcctcactaggcccacatgccagaaggtcatatgtcacttaactacagggatacattctgagaaatgcggccttaggcgatttcatcattgtgtgaacatcatagagtttacttacacagaactaggtggtgtagctgactacacacctaggctacaaacctctatagcactgttactgtactgaatactataggcaattgtaacacaatggtaagtatttatgtatctaaatatatctaaatatagaagaagtacagtaaaaatatggtataacacataaaagttaataagcctgtatattgataagcacttaccataaatggagcttgcaggactggaagttgctctcggtaagttggtgagggagcgatgggtgaatgtgaaggcctaggatgttactccacactgctgtagactataaacactgtacacttaggctatactacatttaatttttaaatttactttcttcaataataaattcattttagcttactgtaacatttttactttataaaccttttaaagaaccttttgactcttaaaatatcacttagcttgtaacacaaacacatcgaccttctgcagctgtacaaaaatattttttctttacatccttatttataagcccttttctattaattttttttaactttttaaacttctttgttaaaaactaagatccagctgggtgcagtggctcacgcctctaatcccaacactttgggaggctgaggaggacggatcacctgaggtcgggagttcaagatcagcctgaccaacatagagaaaccccatctctactaaaaatacacaattcgccaggcatggtggtgcatgcctgtaatcccagcgactcgggaggctgaggcaggagaatcccctgaacccaggaggcagaggttttggtgagctgagattgcactattgcactccagcctgggcaacaagagcaaaactctgtctcaaaaaaaaaaggaaagaaaaaactgagatccaaacacacacattagcctcagcctaatcatcagtgtcactgggatcagtatcatcaatatcactgtcttctccatccacatcctctttcacgggaaggtgtttcaggggcaataacaggcatggagctgtcatctcctatgatctcctatgataacaatgccttctgaaacaccttctgaaggaactgcctgaggctgttttgcattgaacattttttttttttagatagaaggactacactctacagtaagaagtatagtataaatacataaaccagtagcatcattgtttactatcaatatcaagtattatatactatatgtatttgtgtttgctatacttttatatgattggcagcacagtaggtttgtttacaacagcattagcacaaatatgtgagtgttgcatgtgctctgatgtcacaacagctacaatgtcaataggaattttcagccccattataatttcataagaccaccattatttatgtggttcatcactgacggaaatgctgttatgcgatgcgtgactatgctagcagcaacctgtgtggagcaaaactccatactataatgcagttagcagtgacgatcgtgttgggtgtattgagatgaattacaatctctgtgcaggatttagtagatttacagattatattatctgtttttaagaaaactaatgttcacaaaatttcaagtggcaaagacgttatcttggaagaatccatgcattaaagataaaactaattatggacacaaatgaattattttaatagcagagttgacaggtgtcctcctcttagtacaagctccctgtcaagtacaatgcaaaataaaaacaacaatgatctaatcaaagtgaaaagacaatacccccagaatttgaaattgtcaagaaaactgtttgaaatgtgctatttaaaataattacgatctgtttatacacttttggtgggagagtaaattaggtcaaccgtcgtgaaaatcggcgtggcaattcctcaaagagcaaaaagcagaactaccatgaaacccagcaatcctgttactgggtatatacccaaaggaatataaatcactctattataaagagacatgcacgcctatgtttattgctgcactattctcaatagtaaaaacacggaatcaacccaaatacccatcaatgatagactggataaagaaattgtggtacatatactccatggaatactatgcaaccataaaaaataacgaaatcgtatcttttgtgggaaaatggatggagctggaggctattttccttagcaaactaatgcaggaacaggaaaccaaatatcacatgttctcacttataaatgagagctaaatgataagaacttatgaacacaaagaaagaaacaatagacactggggcctacttgagggtagaggatgggaggaagaagaggagcagaaaagataactattgggtactggacttaatacctgcgtgatgaaataatctgtacaacaaacccctggcacatgtttgcctatgtaacaagccttcacatgtacccccaaacctaaaataaaagttaaataaataaataaaataattatgttctgcttttaggatatatatttgtaggtaggataaaacatggactagatgtacaaacaccagattgatgatcgtagttttctccccaatatcaaaagatggcatttgctgacaagaatggattgctatgaactgtgacttgtcaaatattcctctcatcattttttaaaattaggatgtcataatcatacttcatacattaaaacttaagtaattttctttttttaagttttttgagcagttactgtaatctttttttttttttttttttgctattatactttaagtactgggatacatgtgcagaacatgcaggtttcttacataggtatgcatgtgccatggtggcttgctgcacccatcaacctgtcatttaggttttaagccccacatgcattaggtatttgtcctaatgctctccctctccttgcccccccacaggccctggtgtgtgatgttgccctccctgtctccatgtgttcccattgttcaactcccacttatgagtgagaacatgagatgtttggttttctgttcctgtgtaagacttaagcaattttctcagtgtcatttctccatctccactgtggcctaaattgtgcagaacctgctgcgagtctaaatatgagttcacagatgtgataggcagaataacagttccctaaagatttccacgtcctcatctctggaacctgtgaataaatcattgcacatggcaaacgagaatgaataaaggttgcagataaaattgattgataatcatgtgaccttaacatggaggaattgtcctaagttgtccaggtgtgtccagcatccttaacagtaggacaggaaggcaggggaggaaggaccagggagatggcagcctgagacagaatcagtagctaaggaacacaggcatcctctagtagctgaaaaaggcaaggaaacagagtttgccagatcttccaggagtacagccctgctgacaccttgattttagcctcgtaaggcccatttcagacacctggccttcagaactgtaagatttgtgttgttttaagtcactaagtttgcagcaatctcttacagcagcaaccgaaaactaatgcaagagagttcttgatttacatgtatgcatgcttgcaggtatacacatatacacacacacccctaagggagaacccaccaagaactagaaagttgtttgctggcaaaagccttctaacatatggtttagtaagaaaatgtcccgacgttatgaaaccatcactatcacaggccaacataaagaaacaaaaatttgcaacaaatacagcaaaggctttttcccccataagacctcatataaattaatgaaagcaagatcaagttaataaatgagcaaaaaacctctgaggtaattcacaaaataaaaaacataaatggctaataaaatatgaaaatacatcagatgaaaaagaactattgcaaaaataaataaatgaagagatgccattttgtttattttcttggcatgtatctttaagtggaactctcctatggtatggaaaagcaggcattgtcagtcactgctgtgataggatagatgatacaaactttccaaaaaccaataatgtgtaaaaaatagtcataaaaatattcaatggcacttctgaaataataattttacctctgggaatcagatcatcaaaaattcaggaaaagcattaatatttttcacaatattatttataacttgaaaacaactttcaataatagaacattaatacatagcagtatatttaaataatacaaatttatgtagtcattaataattaagcttatgaagagtattaacttgggtcataagagtataagtgatatatagcaactgcaagagagaaagattggagagaaatctattgtaaagttattagtgatgggattagggaccatttctttcttgtgtatgtaactggtttactgaatgggttggtagaatacagttgaaaggcaattttgtttgttctctcactgtcccttcaagtacacattacggctttgttcagtctcaccctttggatcatatttcaagcagaatttatagctcttttagctcctcagagatattaaatatctagtccaggttactgcaaattctcatccacttaaaaactctcccgctcagcttgggcctgatttcaacttgcagatttgcagagaggaaggaacacaacactgcttcctcctcttctcaccccacttctctcactgttcctctgcgttatcgtggggatgaagtagaaggagaaatgatgggagaaaaggaggaaacaaggtgttagcatgacgggttccattgtaatctggcagggatactctctgagtgtgacagctcccacacgctcatgcttcttcttgtggggtgcttttaggggttcttcagaatcccaccccacccccctttaggatccctacctgtttctcggatgatcagcctccctggtttgccactttgcacccctacttggcttctatagccaaagtaccaccatccttcttctgaggtcacctgccctaccaggaagtcctctgggatggctccaactccagaacagcacaggaagatctctccagaggccttacccccaggctaagggcacacacacacatcctgccctgccaattccacccagtcctgtctccacacactgtaaccaaaagcccctctagacacagcctcttgccttctgactcttccaagtgtgagttgggtgccaagccccatgcttcccaaaatgtaagaaatgttaagctccccaagtgctttcgcagcaccccctcacctggcttgaggtgagaggaggtgcccgctgggtgggaggaaccatcagcaccctggcagatttctctgtaagtccttctcctaagacctcaccctaaacttttccctaacctctcaccctctcagggcttcttggcctttgtccagacagtccagagatggatgacaagctcagggtcctaattcacatgggcagtcaaaagccccagatatcttgttctctgcattggaaactttagcctttgacaccaggactatcagaaaaagtttcttttcccggtattattttataatggggttaaagggtagaaacaaacgttaacaaagacaagaagataaactatagcagctatcaagtatctatttttcatacctattgaagtgcttatagtaagtatttttagactggactagattcatagacaattttgtcctctaggaactgcagtgtctttggctccatggaataaaaatcgtcctcttagcatcataaatgcagaggttaaattctactcctgcatttattctctgaattactagtatccaaagtacaaatcatctcttctgttttattttatcactactgaatcaccagcaagttaacgtgttttcttgtggtttgattaacaaagcaatttagtatccaaatatgatttacattcccagagcattttaaataattaagtagatgattggtatttaatttataagcaacatgttttgattccttctgtagcttttaaactttaaaatagttatagttaattagtgctagtacaaaatgctcaatcatcagaaaaaaatcaaaactttaaaatggatttcttaataatctttgctgattataaaatacaggaactgtaagtcccaaatcaaaatctaagtgaaatatctagaaactggtttcttcccccatttctgtgtactttttagaaagctattaaggctgcatagaaatgaaaaggctcttttaaaatcacagctatcattttaaaagagtttttccactgcaaactcttaaaagttgctcataaatatttatctttattagattatattggctctttaagtatggaaacttggcatagattcttaaggtacacattttttcccttttgcagttggtgggttttgtgtatgcctgttatgtgatcagtatttccatggaagaagaagacacatgtaagtactgttttctctctccctgtgggttccttttgaatgagatacagcttccaaaactaatcattacagggctatgaaatgaaatcttttatatttggagtctaaaatgattgaactcagcacactaaagttacagtcaaaagttgacagactgaattgcacacaaataaggtgacactacatatagaaacactcaatttgtgagagcacgtgcagagacttagaaggacaaggactgctgtcatatcatatattagcaacttttcatcagacacctaaccattatgccgagtagacagtcagcggttgttttacctattaccaattttaggcatgttggtggcagaattttgaagtctgagtaacagtaatgatatcaatacaataatacattacagaaagatctatatgtatataaaccatataaaatgcaatgaaaaaaactaaaatttacaaccttccagatgagatgcaaaaaaaaaaaaatttacgaggtgctaaaaaaaagttaatgggatgcttaaaagctaaatcatgttttaacagaacacccaaaggaaaaacatttattaatattatgacctgaagttatatgatagagctttagcaccataggtcaacaaatgactttcattgagtacctgctgatgtataagacacttcttggcacaactctgttagggactcacttttttttatttactttcaaaatttttttttttttttttttttttttttttttttttgagacggagtctccctctgtcgcccaggctggagtgcagtggcgtgatctcagctcactgcaagctccgcctcccaggttcacaccattctcctgcctcagcctcctgagtggctggaactacaggcacccgccaccatgtccggctaatttttttgtatttttagtagagaaggggtttcaccgtgttagccaggatggtctcgatctcctgacctcgtgatccacccgcctcggcctcccaaagtgctgggattacaggcgtcagccaccatgcccagcctactttcaaaattttaatttactttcaaaattttaatttactttcaaaaaataaattattttagataaagaaatcacacctaaccaaaccagagattgcattgcagtcattgtttgaatttgtaacaaaatgaagcaaagtagctagccattgtaacttccttccagaacacaacctcaaaggggtctgatgaacgcttcccatcaaacagatgagtggtgcatgatatatgagttggaatccagaatctgatggggtcttgtctcaatttatttgaccaaacctcagaccctgagattaaaagtatcaggcagtgaaagcatgcagacaaattgcatcatgtatttaatgcttacacagagtttttttttttttttaatgctagataagtcaaaaaatttctgtcacttgacaagtgcagttctaatgacaacacttttcattttgaggttaacttcaaatctctatttttaggagttttattagtagttctacaacctgatggagttaatatacagaaggttagcagcatgcttccaacccagagctaagacaggctgcacagccaaaaaacagttggttgagcatgaacaatattaactggaatttcaacctgaaagttattggaatttgagctgaataagtcaaaaaattaataaattgataagtcctagctgaatctcttacaaagtagatacctacttttgagtagttatcaaacaacaacaacatccaaaacaaacagtcctctttcttttcctcctcactaaactggtcaaagactctcaaaagacaccagtgctcagttgtacctaacagtgggagaaaaggcagattaatcaatagtcttattatgtagtgcaataaatatacaacagtcttttccttgagacttgtggtttaagcaaagctgggaaatgcaaaatggcatgtaaaataaaagactcatctaaatggatacttctgttaactttctattagccttcttttcagtgtatataaattgtattgttcactgccagatatcgtcgttccattgactttgatgtctttaattaacttaagtttctctatagaaatctctgaatcagctatttcagtgcccttcaaactgggattgaagcagctgctaggagactattctattagtggtttaattctagcatttgttattagggccatacattacattaccaagagacatctggatatagtacttgtattgtcatcaattcaaattgactcagagtcaaaacgaaacttgggtgctcaaagcaaagtatatatgccaaagactaacttaacatgataatctgctggaagagagatgataatggaaagcagtcacaaatatttgatagttctcaaatgagggtaattttatattttttattgaatgaggtaggaaacaaaagtgcagatgtaattaagttgtcccagggtcttcagaaggcagatgtgagcaaaaagtaatgtctgaagccaattgcaatgatctcatacactagtactatttgtgccaacacttagcttttaggtgcaaaaatgaactgccccttggatatgacattaccaaccctcagtgaggaagacatgtcctttgaattatttttccaaaacttacacataaaataagtaaacaatactggtatctttccaatttgtctaagtacacttctggaaatcttattctaaaagagatctgcaaatataatataatgtcagttttttggcaggcaatacatcattcataactttgattctattctaactaatgaaaatttctgcattattcaaaatgcaaagttaagccttgttcttgggctgaaaactgccagccagccttaaaaattaataacagctaccacttctctcctctgcactgttaaagtggatatatgggactaacatttcagacagatatttccgaagggtaataaatacttgaggaaacacttatttctagccacccgtcttcttagttacctctcagcctcttttattaactatttcttataaagattatgattgcaggtcaaagacaatgaaataaaaagctcacaaaaggcagagtgctaggtggggtcagagcttctcgtcattcattctaatgaaaaagcttagttatatctcttccttccatttttcattgcttttaaatatatatacataaatatatatcaatctccatgaacactttcatgagactagaatctctggaatcataatgatagaaatctgtcaacaccttgtttgggaatcatttgctgaaaatgaacttgaggatttgttactacttgttagactttccagaaataatgtttttaattcagagaagtgtggagataaggtgaaaaatagcattttacttgtatcaatactgccaggctttttcagagggtctgttgctagcactacttcttctgatattaggctgcaaattgcaactggcacatttatttgggctcacaaaggctagtctgggttgtatatgttgaatgatgagagacaaaagtatattgaaaaccctaacagtttttgaaaggaaatgaatccctcagatgtgggttcaatattttacattaaaaagctctaaatagttctttatataaacatttgacccttgctattatacttttgaggaactttttattggaaggaagcgtaactatcggaaaaacatttcatcgctctactgtcctgaagcttcctgctggctaatgttcatgtatttacctgtctgcccatgaactccttctaagaaaatgaggtgatatttccatagcattggtgtgagctgaaaactttttaaaatcctatctccacctaagaatttatgaaagaagcgaatgtggtaggaaaaaaaaagactagtttgaatgttaatttatgaatttccttttccaacttataatgtatggaagcctcagagaagtaaggtgaccacaaggccagacaccaggggagggaataagcagaggcctggaagatcttcagagtagaaaaccagtccattgttttgcacccctagcaatgtatgaacatttgaaggtgagagcagaggacagtgctgtgagtcaaacatggaaaaatgtgcaaaattggtaagggtgatcctgaagtcacagtgaacatttcaaaggagccaccacatttgcctaataagccattaagaatctactgattctcacagtgcatatatttttttttttttggtaactatctagttggttgcatgtaactgtcctaaaggctgattctctctccttcagtctcactagagctcagatttagatcctgaaacattttcctaatttgctgagatggctctgccaaatagctacacaatgactagctaatcctcccactagcaagatctatgaaggtagaatctttgttttgctccccactgtaaccctatagttcagaaaaatgccttgtatgtagaattcaataaagaaatatttgttggctgggtgtggtggctcaaccctataatctcagcactttgcaaggctgaagcaggcaaatcacttgagctcagcaattcaagggcagcctgggcaacacggtgagacctcatctctaccaaaaatacaaaaacatagccgggtgtggtggtgtgtgcctgtggtcccagctactcgggaggctcaggtgggagtatcacttgagcttgggatcggaagtgggagttggtgggatggaggttccaggtttcagtgagctgagatcctgccactgcactccagcctggctgacagagggagacgctgtctcaaaaaaaaaataagaaaaagaaatatttgttgagtttatagtgttaaataaattttctgggcccaacaactcagttttacaaagtcatttttaaaactccaaggttctcaagtttgatactgctttatatttagaatttagtgagatgtccgatgcacttgcaaatgtttatgtgaggcaagtggaggtcctacatttttaatgcaattagatatatttttagtaattttgaaaatcaaggtatagggagataaagtaaacatccactgtaccacgtcagaacaagagcttaattttgtaaactcctggacaagacactgctgagaaaacagggacttacttgaaagggatgcactcacagagtaaggcaggcatttaggagtcgactcatctgcaacatgtggtgaaggggacagagttactgtcaaagagtggggaccagcagggttgtaacctcggccaccccacacagaggaagttcaggcagcacagaacaggatcccagctacagtgctctggttgagtgacaagattccatcccttaaataggttactgagacagactctctctcaagaatatcataagcattcaaatgcccaaaccagcaaaccaactggagattccctacaggggaaagatagagaagcccctttaccagaaccagatccaaggttaccactaaactcacagtgaagtagagcctaaaagattgcctatctccttaagccaggattcctgattataattcagcctgactaagaatcatctacagcgatatatcctactctcctccctccccaacctccagccacatctgttttcctgaatccaccaagagctttcatacccaggcctttgagagaggcctcctccctctgttgacccactaacttatatacacccttcagatttcagcttagctgtctcttctgaaatttaaccatttttctcccaccctttccgggttagttgaagatacggatgatatattgtgagatgctttcactgcacactgtgctttttccttggcaacatttaacacaactgtaattttttaaagtcatattattcaccaaggctgaccccatttcctaacataaagggaaccctacactattttcaatgaataaatattaaatgaatgagtcaatgtatgaacaaatggactcagtaagatgattagggtttccaatggcagagatcggggagaaggttcttccttttctcctctctatctccatttatataaatgacagctcttcacatcagctgaaaagcttgggcatattccttgtattccctgactcttccctgattgtccacacccagttaatcatcaaatgaaacatcttcacctcctgtcttagttcttctgggctgctatatcagaataccatagactgggtagcttataataacaggaagttatttcacagagttctgttgtgaaaagtttaagatcaaggtaccagcagacttggtgtctggtgagggcccacttctctcttcataaatgactgtcttcttcctgtgttcccacatgggcaagcaagcaaggcagctctctgaggtctcttttataagggcactaacccatccatgagtgacctaatcacttcccaaagacttcacctactaacaccatcacgctggggattaggtttcaacatatgaattggtgggggtgggagggtaataaacattcagaccatagcatctcctttcaaataactaaaaactcctacatgttctttaacattcttctcacaaacaccctcttctccatgccgcagtagaccctgagtgtgtctctgaatctgcactcaacttactttttaattaattgcatcccccactcataaaaggtggagatcatatcttacctaccgtagaatctcagaacctgcttcagtgtatggaacatcataggaaatcagtgcatatttgttatacaaaatacatagtggagaaaatgcttgtctttacgttatctctcatatctctttcctcactccctaagaaaatttaaacttcccattccctgtaccacaggaaaaaaaatgattaattcataataaggtatttgtgcacttatatcttttatcaattttccagagcaaaagcatggccctatattatgcacttacattatctggaaattttctggagagaaggtgtagcttgttttgccaaaaacttgagaccagcaagcagacaactcctgcaccccagagggggttctaattttctgtgtttctacttgaaaccagatgttagaaatgatttcagtgatggtggtcctaactgccaatatctagctctgtgaccattgctgaatcacatcacctctttggggatccgcaagtcactgacagctctgacactgcagttctatagatgatgcttttgggtgggggtgatttcaacgtgtgatcaggcacgtcacatttccttcttcactgatttacaaatggtcaacatcaggagtggtttcaaaacaccctgacctctatgctccagagttacagtaacaaagtctgatgtatcagcctcagcactaaaacaggccctctacacgaatgcctgcccgctcagaaggaggaatcacatctccctactccctgctttagacaggtcagagctctccagttctcaccattaccaacagtgccaggctgtgcagcacttctcaagcactttacttgagaaggaagaatgaagaatctgccattcaggtggtgccgagtggaaaatgtgggatttgggatgcagatgtgataatgagggagcagagtaccaaatttaaaaatcacaccctcgtgacaccctggatgcacagcaaagaaaaaaatggactgtaaggatttcatgaggatcttgtgcaatagttttatcctggttattagtggtaaaatttaagagcccagcagaagagcagttgacagcatcttgccagggcctctgtgtttccattttaaatctaaattcagtattctaatcccaacaaccccccttctcaacggtctcacaaagctggctctgccagcccccctgtgggtttactgaacctccacttctgcacgtctgtccctaagctgcttagtggtgcagagaggagcacatagcctgatgcaacctcacaacgtcacatgtgagccgcccaacccgctccaggggcctcccactcattcttcatcactgctttctccaaggcccctaaaagtgaattatttgagctgtcagtgccgcagatcaccctagcctcattttagagaacttagagtttctatcctcattttggggatgaataattgaggcccaaagaggcaatgtgaccgccggcggctttttcctcctctgccctgcacccttagcattaagactccatcactgagactctgtcacacaaaaaaataaaagcagtgggaatgatttcctcaagttcccaggctctctatctgtcagatctgtctgtatccatctgtgatcatcatcttcctgacagaaaaagcagacttcattttgtcccgtggcttttgtggctgctatgtccatcccacccacctatttaagcaccttgctctcttaattattttttctctctgtcccctcccccaactttactccctctgcccagcttcttcctccactaggtcttttcccttcagcttataaacaaagtcacatcaaccagaaaaagaaaatagaaatcacccttgactccaactggcatgaatttaactttcctgtctgtcatactcctttcctccacatcccaacttctctcatactccttccctccacatcccagcttctctgcaaagtggccgagactgacagcactcccttcctcacccccctcccactcactctcatgcctcctgagttatcactgaagatgctgtctcagaggccagcagggacttcctaattgtcaagttctcttggatcttatcaagattgattgacagctttggctgctgttgacttctccttccttgaacactttctcccctggatttccagaaaatcgcatctcttgaacagcacatattttgccaattaaaaattatttttaatatctagtgttcaatagtagagtgactataatttacagtatctattgcactttgggaaatagctagatgagaatattttgaatgtttctaccgtaaagaaaagacaaatatttaagtgatgtatatcccaagtacactgatttgatctttgcaaattataggcatgtattaaattatcacatgtgcccccaaaactatgtacatctattatgcctcaatttttaaaggtactttaaatattcttacgcagattaagcagatttctgatgcagacacaggtaaccaattttgaacaacttgttcaagctgcttttggagtgatgagctgtcattatgtccttaaaatattaactaatcattcctactatagagtttatattaacattcacactgttatactaaagcattttcagtaaggtcagccaataaaacagaaatgtttttaaagtaagaccagacaataaaagagatgtttatccttttaaataacaaaatggcatataatatttttaagagctatagtcttggaccaattatttaagatttaatggagatctgattttacactaccttaaaaagaagtatcatacaagtaaccagcaataaagggcatatatggaacactcatcttcatgttctctagactatgtactttactaagaaaaaaataataatttagtgttctttctgggaacaatatttgaaactgccacctaaatgagatattagggagtattcatatgacttgaatgcaagtgtgaaaaaaaatagggaacatttggtaaaagcatttatctctccttctaaattgtataagacacaaagtaagttaattataaattatttctaagttataacaaactagtgtttccattttatccacatttttcctcatagaaggaaacagatctttctctttctctctctctccctctctctctttctcgctgattttaagtacagaaaatctatattaaagttagtggtattttctgaagacatctttctttgtcacagttcaatcaactacaaaactcctactgtttcccaacccttattcatttaataccaccttcagcgatatcatgacagctatgtacaagcttgtgtcagagactggctggctcttcactaagcccgtttgtttgttctcctcccaagcacacaattgtaccatctatcccagcctccaggcagttagatgccccatgagattgtattctagacgagggttccagtcctggcccccaaattacttccacgtgtgattcttcatgttcttatcctttcttcctgctggacatagaccagcactgaagctttggaagccgcacgtttcaaatgctggagccacagtatcaaacgggcctgggtcattgagtgttgctcagagaaaggttgaccatataatttgagaagcaggtgataagtgcctttgaggcataaggcactgaggagcacctgagagagtctgtcagagaaaggttccctcgcagacagggagaccccgagtagaaacaggcaggagttctcctgtcattcaagggagagttaggagtccagcgtatcaagcattcagcaaacagaagtgcctccagcatgcctgggaagctctctctgagaagaggacatgtaggctaacacctgaggatgaaaaggagctaagaggcaaaggccaggagaccattcctggcagaaggagcagtaagcatgcagggaatcacttactggaaagccttccagccaaaacaaagggcttgacttcagaagcagcttcataccaaatggtcgaagagatgatctgggcttccctgacctgctgactctcaaaaaagtagtgaattaaagggcagattgtcccagagactgcattgtaaatcccgtattgagcaggagggctctgtgaaaaggataaaaagtatactgtgttttcgtatgctgtgagaaaaaaatcacaggttgggcttaagttttattttcttttcctttgctctatatttgcctccttttctatttactcacccacgtgtttatttggaaaagtaaattaaatctgtttcttttttacttaaggaaaacaaacacttagttactagtcctaaagtcaaagccaaggtgtcatactgactgtgttttcctcctaactgagacaagaaagtttcagggaaacaggtgaagaccaaagtttctctatgactttgtacattttcatgagggaggcttttctgcccagaaaattctattaatatctactcagggttttaaaccattatgcaattttttaaagtaacaaattttttaaaaactgtggttttttgtttttttaagctctaaatcaagcttgtccaacccgcagcccatgggccacatgcagcccagggtgactttaaatgtggcccaacacaaatttgtaaactttcttaaaactttatgagattgttttgagatttttcttttagctcatcaactatcattagtgttagcttattttatgtgcggcccaagacaattcttccaatgtgtcccagggaagccaaaaaattagacaccactgctctagatgctacatagaactttaagtattctgcttataaatctagcaagtgttaagagtcactttaggggagagcttcttttcattgtgctaaaatacgtgacataatattaaccattttaatatttttaagtgtacaactcagtggcattaggtacattcagagtgttgtgcgaccatcactactatcatttccagaactttttcatcatcctaaacagtatctctgtacccattcaacaacaacttttcaacttttcatcctcccctccctccagcctctagtaacctccattctaccttttttttttggagacaaagtctcattcttgtcccccaggctggagtgtgatggtgcgatcttagctcactgcaacctccgcctctccggttcaaacaattctcctgcctcagcctcctgagtagctgggattacaggcgcctgacaccatgcccggctaatttttgtatttttagtagagatggggtttcaccatgttggccaggctggtctcgaactcctgaccacaggtgatccacccgcctcggcctcccaaagtgctgggattacaggcgtgagtcacagcgacctgccctctattctactttttatctctgtgcatttgtctattctaattacctcatgcaaatagaattacacaatatttgttcttttgtgtatggtttatttaatgtcccataaggttttcaagtttcatccatattgtagcatgtatcagaatttcatcctttttttttttttgagacggagtctcactctgtcacccaggctagagtgcagtggcgcgatctcggctcactgcatgctctgcctcccgggttcatgccattctcctgcctcagcctcccgagtagctgggactgcaggtgcccgccaccatgcctggctaattttgtttttgtatttttagtagagatggggtttcaccatgttagccaggatgatctcaatctccttacctcatgatcctcccaccttggcctcccaaagtgctgggattacaggcgtaagccaccacactgaaacttcagttactattcaatctgtttaaattcaatagtctacattcctttaaataatctgttccatttgtaacttaaattcccttaaacatttaacatgaattcattgtaattatcatttttggaagtccttcatatatttgtcccaataaacaaaacattcgctggtttttaagctaatccagcaaatctaataaatctaataaaataagctcattcataaattaaatctcaagtttttataacattacacaaatttaataaaatattgtcatgtctttcaacctaaaatcacaagtataaaatcaatcactcaattaaaattttgaattggtttcagtgggttaatctaacaaatctaatataatccatctgattattttaagaactaaaaagattttatataccaagcagacacagattatcccaatgattataaaattctaacctgtactttctgaaatagtattaacactatatgggattagcttactttgttttctctatagttaatttcatgtgttagaaatacacttctccaataaataagcatctcagacaacttaagatttctatatgttcaggaattttcggcagggaagcggtacccaaattctaagaagattctatagcttaccactaatgaatttaaagagcttttctttaatagttgttggaacaaaagaaaatctcattccataaaataatctagcaggccacagctacgggactcaaaggacattagatttgaatacagaagactttactcctactaagagtctcattttggttggtttaataattgttagccctttaaaacattttaacatcttttcatatggcttgacagacactttgttgatattccatttgcttcttttaatcatattacctgatggaatcctgtattctttccatattttaagtaggctgctaactcctgtacgcattgaaatgtttgattggctgtatttctctcatatcttttcttgttctgaggtcactaaactgttcatattcaaaagcatttatagtccagaggcaaaatattattgtttaattttagacttttaagtcccttaaatacttaaactgcaaacatgaattcactgtaatgattaatatcattttttagtccttaaaatattgtcctaataaacaaaacaagcataaataaacaaacttaaatagctaatttttcacttattaattgattcactcattcaagaagcaattattgggagacttctgtgagttaggccatgccacaaggatacagagattaataaaactcgatctgccagaagatcttacattctaataaggaagtgaggtaggcaaataattacagaagagtgaaatgcagatactggtttgtgtaaagtgagtcagatgtgcagaaaacgtaagcagaggctaactgtgtctcaaggcatcaaatgtggctgctcagaacatatagtatggtctcatgtgcaaaatacacatcatcaggaagagaacaaaggaaagacattttagataccagggaaaataagctataatagcacagaaacaccataaaatatttaggaatgtttgtggaaaatctggatcaatcaggaagtcataagttactgggtacattcagttcacgaaatgaatggtgaatcagtccttgagggaccttggattccattttacactagtgattttcaacctatttcatacttggcactcatggagaatgcctcttttttaaatttgtttttttagagacagggtctctctctgtcaccaatgctggagtgctgtggcacaatcatagctcatgcagcctcgaactcctgagctcaagtgattctcccacctcagcttcccaaagcactgggattacaagcacccggctggagaattccaacatttataggcatccagtggtagataaactagccatctccgaggaagaaatgtctgccctagaaggctaactaccccaagcctcactcaatgaacacacacacacacacacacacacacacacacaccagggaatgagagaattgataccttgtcacatctgtacccactcaggtcacaccacttcagatgctctgctggatgatgtggagcagtgaatggatttaatcttgggaatatgatcaaattcagttttctttgaacagcaattcatagaaagggaaaaggatttataaaagagatctcagtgagcaaatggcattttcatggagattgtcctaggaaagagagaaacaaaagtaataataggagctataaaaaaagaaagtatttcaaaacggaaatgtccaaaattgtgaaagcggacagtaaaaaggaattatgaagagacttcaatgccagcaagcatttgttacttgatttaaagagcaaagtaaaacattggctacacttaaataagaatgattaaaaaatatattgcgggaaaaaactggataactaagaaaaaatgtattacataggaaaagaatttgtctaaaactatttaggcaaactctcaggattgttttaagcctcttaccttttggaccatgattttttctctcagccattctattctgcttcattgactccaaagagtttagaaattcattatcctattatttaaatatcatacactattagaaaattttaaaatgggaaaaaattgtcagcactgagtatgagaaacatctaattccaaagatctggactcacagtgggagcaaaagccagaagtacagtcaaataaaaatgttgaatagctccaaaaatagaaaaggtaggtgttttcaagaattttttccaatcttattttctcctgaataaaaggttcctccaaatgagcccaacaatactgacacaaaggcctcagccaccagtgaaactgaacagacagtaattgaaaaattacaaaaactttgagagggacttcagtaaggccaaggcagtcactccatctaattactgagctcttgacaaagattaaggaatgattgagggcatatctactatagagaaagagagcacaatttgtgtgtctttaaaaagaactgagtgactcttaaaataagagaaaatgtactattaaagatactgataaagtcttgtgtggtgacacgcacctgtaatcccagcagtttgggaagccaaggtggaaagatctcttgaggccagaagcttgagaccagtctgggcgacatggtgagaccttctctctaaaaaaaaggaaagaaagaaaagtagcagggtgtgctggtgcttgctgcttggaaggctgaggtgggaggatctcttgggcctaggagattaaggctgcagtgagctgtgatgatgccactgcagtccagcctggacaacaaagcaggaccctgtctcttaaaaaaaaaaaatgcagactaaagtaagaaaaataacttattttttccaaatgtgagaaaatcaacacaaaaaagtttttatctgttaggggagggctggaatggtgagagctggtgtgttacagacatctttattaagacagtacaactcttgcaacaaaaagcaatgacagaagctgcagcagtagtaaatgcacccctgtaaggactctacagcctggttccctgactcaagaatcaaaaactaaatactaaagcaagcacagtccaggagatcctcacagaataaccagaataagcgtatcagtgaatctaaaggaataacactgaaaacaattggaaaaagccactttgagcaccttactcaaaggagatattattttcaaagactctctggagtgacttgaaatgacacgacaggagagagatcttatctcatggtttgtgctactggggaaaaaacggggtagaaaatgaaagcaatgccagtcaaaagctaaaggaaaggtgagcaggattgtcctgagcaccaggcattgacctgcccatggactattcagcagccctggagagggggaaggagagcacttccacatgacactcaaattcacaaattctgcctccacggagttttcttttctttcctaagagacctttatgcagacaagcttcctttccagaataaaaacaagtcatagaagataaaaccattattcctcaaaatgtggcacactaatgaattttcccttccaaactagctgttcattttaaatatgaagaaatccaaccaaacacaagtacaagttcgtgaaagttccacagggacacaacactgttcgggggacagcaaggacagaatgttggaattcttacagatcattatgtaatcctacattagacagagcctttgaaattttggaaataacagttaatgagagtgtatcctcaaaataagataaatgtttaaataagtcagcaacagcttgttgtttactgcatgctttctgtgtgctggcactccatcgccattaccttgtataaggtaatgacaccctgtgaggcagccattgtcctcattttacagatgagtaaactacaatttttttttcccaactcacatagcgtgtaagaactgcaattaatatttaatccagatattttgggtgccaaaatccaaatgcattccaaaatgcagtagtacctttctttccagaattttgttaacaataaagttcttaataaataggctaaaaaagatcgatatacatagagagaaagagagacgttagtcactcactagattaaaactagaatattcatatttaaatattgagtgataatacaaagtactggcacaatgtagggaaaataatggattagcccactaaaatttaagtggatatgaggaggcacatgtaaaagaacacactcaataatcttctctcaaatcaactgtctcagcacagactatttaatatgtgaagcttatcattagaaaaacagaatttcagaatccagttcaaatactgaaaaaatctaaaaacaaaaaaatttaaaaacaaaaactgtgtttcattttaatagctgcaaaattctatatggctatccagtgaaattatgaaatagaagaatacaccattgttaaagtctgacttgatacaatgtaagagaatatgacatgacagatgttgtgggtatgattttaaaaagcaaaaatgtaaccaccgctatttcccaaagaccggacttaatgcttcttcctcatggtagtggcttgcagaagaacttggccatcttcgtgatttcgcagctacatcaagtgcaagcacagggactgattctgaagtcagggttgatgtggtggtgtgggctgtgaggagtgggagtagacatccgcttcctttcccatctttcctgttggcatccactgagctgtgtaagtgacccactcccactgtggtctcagttgtcaagcatgtcctgctcttagctgtcagcactccgcatgtgaattacagtggagcctgggactccataccaacttcctgagcatcagaactgctgtttcacttgtcttccataatctcacaaatgtctatataaccaaccctaactcagaaccatatacagaaggaaattccaggacacataactccagcttagataaattaacaccatacaaaatcactacaatttttaataataaaaatgaaagcattactgttctgaaattatcccatggaatctaaatgctatagtgatttaatattcatcattatccatctttaatgtccctaaacaaactttagtagttacaattttaaaccattccatcttatttttggacattttctacattccacttcccccataaaattctgtcctaatgtcatatgtttattctgctaaaaatgttttcttaactcgttatatatttctgcagtaaaaaatcttgcagattgtaattccattctcaatgttatcttttcatgaacaaaagtttttaatttgtatagttcagttattaagcttaaagtaagaaattctgtggttagtactttttcatactttttaggactttgcctaaactatgtcccatgaagatattcttctatattatatcatattatattatatattaagcatcttacattgtgatctattgatttttacatatcatgtgaggtagaaatcaacattctttatttcctccatatgtgtattcagttgaccaaaaacccttcacataaaaaactattcttgaccacattgcaaagaaaatggcagacaggagacagaactaacttgcggctcccactcagatagacagaacagcatgtggagactcacatcatgaacttttgttccaagaactactgcaggaacatatcaggaaaactgaaagaattcgtagagcctttgaaagaagtggcttgccactgcgtactccgtgaaacagccgaaaactgtgagtgcccaaagtgtgagagggggaatgtctgtttccaaccacacatcctcactgggaaacttgaaaattcacatcacgggagaagaatttaaccttacctagagctgaaatgaatttagagagctgagtgaaatataaaagtagaagcagcagctggaagagccctgtaaggactcctcgcccccaaggaagaccagggaagctatttattactttatttcacaggggaccttggggagggctgccagcggaattggggaaaaactacgaggagaaagaaactccctactaaactttgtaataatttaaacataatgtgaattttcctggacagaatctgtagtgggggggcaaaagggaagtacagatacaaccacagaagcctcagcaggcagggaggggtgaagtctgaaagccatgcttgctttctcagcagggaggtttgtagcctggggcaagttctcagccttgcttactggttgcgtggaaataaatttggtgctattgggggtgacatagtgagagtgagactggcctttctggctgcatgagaactgactgaagcctatcattgccggctttctcccactaccctggcaacctgtatgacacagcagaggcagccataattcccctgggaacataactcccttggcctgagaaccacaactccataccccacagcagccatggaaaggcctgtccaaagagaggctgagctcagacacgcctaaccctgccaccacctaatggtctttctctacccaccctggtagccaaagacaaaagacataatatcttgggagctctaacggccctgccctcaacctgagaaagctgagtgctcctccaggtgaccgtaggggaagtttgtatcctccctatactactacagctgatgccgtcttgaaagcatcacctcctggctggaggctaaccaactcaaaccataaaagaacaactcataaaagaacatcactgccccaagaaaggagaaaacaacagctaatttcaccacctgtaacatcctggctaaccagaggtcctgagtctttccatgtgacaactttactgccagcacaaccagcattcaagaaaagcagtgcactaaacaaaaccataaccaaagtctcacacagagtccacttcactcccctgctaccttcactggagcagttgctagtaaccatggctaagtgacctgaagacagttcacaccataggactctttgcagacacaccccagtaccagcccagagcccggtagctctgctggatggctagacccaaagagaaataacaatcactgtagtcaggctcttaggaagccccacccctacgggaagaggggagagcaccacatcaaggcagcaccccatgaaacaaaagaatctgaacagcagaccttgagccccagatcttccctctgacatagtctacccaaatgagaaggaaccagaagaataattctggtaatatgacaaaacaaggttctttaacaccaccaaaagatcacactagctcaccagcaatggaccgaaaccaacaagaaatatctgtatgccagaaaaataattcagaaggtcgattattaggctgttcaaagaggcatcagagagaggtgaagtccaacttaaagaaattttttcaatgttactggatatggatggaaaaatctccagagaaatagaaagcacaaattttaaaacaatcacaatttctggaaatgaaggacacacttagagaaatgcaaaatacactgggaaatctcagcaataaaatcaaacaagtagaagaaagaacttcagagctcaaaaacaaggcttttgcattaatccaatctaacaaaaacaaagaaaaaaatcagaaaaaaatgagtaaagcctctacgaagtttgggattatgttaaacagccaaacgtaagaataattggtgttcctggggaagaggagaattctaaaagtttggaaaacacatttgagggaataagtgaggaaaacttttctggccttactacagatctagacatccaaatacaaaaaactcaaagaatgcccaggaaattcactgcagaaagataattgcctaggcacatagtcatcacgttatctaaagtcaacacaaaggaaagaatcttaagagctgtgaggcaaaagcatcaggtaacctataaaggaaaacctatcagattaagagcagatttctcagcagaaaccctacaagctagaaggaagtggggtcctatctttagcctccttaaacaaaacgattatcagccaagaattttgtatccaacaaaaccaagcttcataaatgaaaaaaaagatatagtcttttcagacaaaaaaatgctgagagaatttgccactacccagccagcactacaagaactgttcaaaggagctctacatcttgaaacaaaacctcaaaatacatcaaaatagaaacttctgaacacataaatctaacaggacctataaaacaataatacaatgaaaaaaaaagcaaggtattcaggcaacaactagcatgatgaatagaatagtaccttacatctcaatattaatgttgaatgtaaatggcttgaatgctccacttaaaagatacagaatggcagaatggataagaattcaccaaccaagtctcttctgtcttcaagaaattcgcctaacacataaggactcacataaacttaaggtaaagaggtgggaaaagatattccatgtaaatggacaccaaaagagagctggagtagctatttttatatcagacaaaacaaacttcaaagcaacaacagttaaaaaaaaaaaagacaaaaagggacattatattatgataaaaggactagtccaacaggaaaatattacaatcctaaatatatatgcatctaacacttgagctcccaaatttgtaaaataataactactagacctaagaaattagataggcagcaacacaataatggcaggggacttcaatactccatggacagcactaggcaggtgatatagacagaaagtcaacaaagaaacaatgaacttaaactataccctgggaacaaatgaacttaacagatatttactaaacattctaagtaacaactgcagaatagacattctattcataagcacatggaacattctccaaggtggaccataagatagcccacaaaaccagtctcaacaaatttatgaaaattgaaattatatcaagtactctctcagaccacagaggaataaaactggatatcaattgcaaaaggaaacctcaaaaccctgcaaatatatagaaattaaataatctgctcctgaataattgctgggtcaacaatgaaatcaagatggaaacttaaaaattgtttgaactgaacaataatagtaacacaacctatcaaagcctctgagatacagcaaaagcaattctaaaggaaaagttaaagcattaaatgcctacatcaaaaagtctcaaagagcacaaatagacaatctcaggtcacacctgaaggagctagagaaagaagaacaaaccgaatccaaaccctgcagaagaaataacaatgatcagagcagaaccaaatatattgaaaaaaaaaaatacaaaagataagtgaaacaaaaagctggttctttgaaagataaataagattgatggaccatttgcaatattaaccaagaaaagagagagaatccaaataagctcaattagaaacaaaatgagagatattacaaagaataacacagacaaagattattcaaggttactatgaacacatttatgtgtacaaactagaaaacctagagaagacggataaattcctggaaatatgcaaccctcctagattaaaccaggaagaaatagaaaccctgagcagaccaataacaagcagcaagattgaaatggtaatttttttaaaaaattaccaatagaaaagtccaggaccagatggattcatagctgaattctatcagacattcaaagaattggtaccaatactattgacactattccacaagacagagaaagaagaaattcttcctcaatcattctatgaagccactatcaccctaagaccaaaaccaggaaaggatacaacaacaataacaacaacaaaaactacagaccaatacccctgatgaacatagatgcaaaaatcctcaataaaatagtagctaaccaaatccaatagcatattaaaaagataatccaccataatcaagtgggtttcataccagggacacagggatggtttaacatatgcaagtcaataaatgtgatacaccacataaacagagttaattaaaaacacaaatcacatgatcgtatcgacagatgcagaaaaagcatttggcaaaatccagcatccttttatgattaaaactctcagcgaaattggcatagaagagacataccttaaggtcataaaagccatctatgacaaacccacagccaacactatacttactggggaaatgttgaaagcattccccatgagaactggaacaagacaaggatgcccactttcaccacttctattcaacacagtactggaagtcttagccagagcaatcagacaagagaaagaaatagagggcatccaaattagtaaagagaaagtcaaactgtcactgtttaccattgatatgatcatatacctagaaaagcctacagactaatccaaaaagaacctagaactgataaataaattcagtaaagtttcaggatacaaaattaatatacacaaatcagtagcagtgctgtacaccaacagcaacaaagctgtgaatcaaataagaactcaatccttttacaatagctgcaatatatatatatatatacacatatatatacacacatatatatacacatatatatacatatatatacacatatatatacatatatatatacacatatatatacatatatatatacacatatatatatacacacaatacttgacaatatacctaaccaaggaggtgaaagacctctacaaggaaaactgcaaaacattgctgaaagaaattatagatggcacagatggaaacaccccatgctcatggatgcatagaatcaatattgtgaaatgaccatacttccaaaagcaatctacaaattcaatgcaattcccatcacaataccatcatcattcttcacagaactaaaaaaaaaaaaaaaatcctaaaattcatgtggaaccaaaaaagagcccacatagccaagtcagactaagcaaaaagaacaaatctggaggcatcacattacctgacttcaaactatgctacaaggctatagtcactgaagcagcatggtactgatataaaaataggcacatagaccaatggaacaaaatagagaacacagaaacaaagccaaatacttacagccaactgatcttcgacaaagcaaacaaaaacattaagtggagaaaagacaccctattcgacaaatggtgctgggataatcggcaactcacatgtagaagaatgaaactggatcctcatctttcgccttatatgtataaaaagaaactcaagatgaatcaaagaattaaatccaagacctgaaaccatagaaattctagaggataatattggaaaaacccttctagacattggcttaggcaaagacttcattaccaagaacctaaaagcaagtgcaacaaaaactatgataaatagataggacttaattaaactaaaaagtttcttcacagcaaaagaaataattagcagagtaagcagacaacccacagagttggagaaaatctttgcgaattatgcatctgacaaacgactaatatccaatatctacaagaaactcaaactaatccgcaggaaaaaaacaaacaaacaatcccatcagaaagtgacctaagacatgaataggcaattctaaaaagaagatacgcaaattgtgaacaaacatatgaaaaaatgctcaacctcactgattatcagggaaatgcaaatcaaaactacaatgtgataccaccttactcttgcaagaatggtcataatttaaaaatcaaaaaagaatagatgttggcatggatgtggtgaaaagggaacacttttatactgctggtggaaatgtaaactagtacaaccactacggaaaaaaatgtgaagattccttaaagaagcaaaaatagatctgccatttgatccagcaatcccactactgggtatctacccagaggaaaagtcattatacgaaaaagacacttgcacgtgcatgtttatagcagcacaactcacaattgcaaaaatatggagccagcccaaatgcccatcagtcaacaagtgcataaagaaaatgtggcatatatttatatgtgtgtgtgtgtatatatataaagaaaattttttaaaatgtatatatttatatatttatatttatatgatatattatattatatatggtataatatatttttatttttatatggtatataaatatatatatatacaccatggactattactcagccattagagggaacaaaataactggataaaattggagattattattctaagtgaagtaactcaggaatggaaaaccaaacattgtatgttttcacttataaatgggagctaagctatgaggactcaaaggcataagaatgacataatggactttggggaatagggggaagggtgggagtgggtgagggataaacgactacacattgggcacagtgtatactgcttgggtgatgggtgcaccaaaatctcagaaatcatcactaaagaacttacccatgtaaccaaacgccacctgttctccaaaaacccattgaaacatatatatataactattatttccctgttgtcctatgatggcacctttttcataaatcaagtagatctattttctaactctattatgtttcatttatctattgtcctttcttatgtaatggcatactctgttaattactgtaatttacttgaaaaaaagtcttgatatctggtagtataagttcttcaacttggttcttcttcaagattgtcttaactaatcttgagtctttgccttttcacatacattttagaaatcagcatttttattaaactgctgaaatttttattgggctttctttgaattcatagattaattgctccacagatcaattggtagtttataatattgagtttcacaatccattaatgctttatattcttccattcatttagacatatttaatttctctcaattacattttactgaattcagtgtagtggcttgcaaatcttttcagatttattctccccaaaaaatgaattttccctgtaaactggaaatttttaagtgtttaatttctgctttggatgggaatataatttcaattattggccatcaacatgattgagtaaacataaattcaatataaatcttgatgagtaagtcctaatcataaaatgaaatatttgttggaaaagcacctcttaatgaaatgaatgcagcagttttgtttcaatcagttcatgtcttcatggatgaatattagttattgctagaatgataggctacctcaaatacttccaatatttggtgctagtatttatttatagaaaccttgttcacagaaaaaatacaagaatgggaagaaatttgctataacaatgtcactcaattttttaaaattccttccttccccaagtattttttaagacctgctttgtactagacactgttccaggtttgggggctatagcagggagcaaaacatataagagcagacaaaaatttttcccttataaagtttaacttgtaatgagggagtctgataacaaatgaattttttaagtaaaatatacaatatagcatagtaaatagtgataagtataaaagagaaaaaagtaaagcagggaaggagatagaacatgtgcagaaggttgatctgtagataaagaggctgagatatgtgcccaaaaatacataatgacctatcatctaaagttatttttaaactactactactagctgatgaggttcttcttcaattgttttggaagcaaaagattgaaagccagctacctttttattagtagctattactttattaacatcagcatacaaaattaaaactatcactttgtttggtgacccgcaggcttgttctgccaggatgatgcaccaagttaaggttccagatggctgagataaatgcctgtccttgcaaactggaaagaagatgattatagaagggaatgagagaagcaaggtccagaatggccatactttttcaaaggcacataaattttggaattgagtctcttgaaattgaacactctacatgcctacacaccatttaggaggtcttacattcacttggggcacaccttctccagtttgaagaccactggtctcttattgccgcccttctcactccccacaatgaggaagaatgaggatccgagacagagttggggagacttccagaccctccagactcttggggattgccctcagtgtttgtcaaaacaagttgccctcaaggacaattgaactatatcagttcttcacataagtacctgagactgagggggacaggacagagtgggaagcatccattttgcatagtattgctgagcagaaagaagtaaaaaatgttggtaaactctgatatggacaatgcaggctcttggactgcatactctattcttccagttggaactggcttaacattgagcatttcattggtcccatgtgcttctcttcaatttcacatgccttctgaaaggtggaggagattttaaacttcctgaagcataaagaaaacaaccataaatagtgataaagctggcacttgggcatcatctccctgcttggacatctcttcgggatcacaaagttatttcaggaagggggtagcacagccccaaccacccccgggacataagcaacggtttaaggcactgtcaagtccactgtgcccagcagacccatcatggtgccttggtggccactaggtatgccataagcagccccaactgtggcctgtgttttggcacagcaggccgtgcctactgaatgctcagattcttcagacaggagacagcaacagatcagtgacactgcagagtagctcattctctcgtaacagcagcagggtttagttgccagctacctctgaaataactagtctctcctaaaagccttcattatggtggggtgctgcgaactcctctctgcagtctttgaagggcctctctgtgtgaactaagttgatgtcaagcctcttccccagctttatccttatgaatttatatcacggaacaagaaaatcacagtgtaatagcccccatatttgagttcttcaaatgtttctttaagatgttattgctggacttggcaacttgtaaaataaatgctgattagaaaagcctaatacctacatagcaggaacaatgatggaacagaaagcaagctcagaataaatgtgttaagtgcctctcagcttcctgagtcttttcttttctctgacctaaacacaatgttataggggatctgtgctcctaaactcagtgacgaggcagtgtgcaatatagctggaacaaaacaaaacgcctacgttctggttaattatttgctgaatatagttaaacctgggacataaatgacagcttgagctcactggaaatggcaggttttcactttaagtgtatcaaaggcaaaggcaaaagtctcaatctgaggctcttaacctggagtctataaatgcaatgggctgtgaaccccatgaaataaagtcatttaatggatatagaagtgtgcactttcttacaaaggggttcctcaagttttataagattataaaagaggtctgtgatcctaaagataataagaatgatgactaaatattctcaaaatcttataattattaaccccttcccctccttcactgaggcagcaaacacttgctcagtgcctaggacttccgcactcccgtgacatctgctttggggaaacaaacatgaattaaagttctagtgaagaagaagaattaaattgatatatttgagctccttccaagggctggcaaggcactgtcctgtatataatatacatttttcttgtcaatcttcatagtaaacccattggaagttactattagtgttagccattgtagaagaatttaatttctaataatggtcacaacagtatttcctgtctaacttccccatcaagaagtggggagttgctgttcttgcctcttaagcccaggctggatgggcagctgtcctgactaatcaagtttggtggaagtggctctgagtgacttttcaggccagatcatagaaggcgacacagcttctgcctggctatatttggttgctagcccttgaactcatctaccattttgcaaggaagctcaggccacatgtagagccccttgtggagagcaacaaggtctccagccctcagccccagctaagcaaacagccaacagcctgtcttgacttgcctgccatgtgaatgcaccacctcagaagctgctcctgcagcctcccgtgccccagctaacattgcatggagcaaaaataaacctttcctgctaggctctgctcagacgtgccaatacatgagcaaaacaaatggtgattattgttttaagacactgttatgtggttgggtgctatatagcaatagataactagagcaagcagcttgcccatatgagcaactgccgcttagaggttaaataatttgcccacagttacacaactagtaagtgtagagctggaattcaaaacaagatctgcctgatacataaaatcaagtcaagaggatgaaagagagagttttacctatatctgtgacttggtatttccttttttttttttctttttttgagacagagtctctcactctgtcgcccaggctggagtgcagtggggtgatctcggatcactgcaacctcctcctcgagggttcaagcaattttcctgcctcagcctcccgagtagctgagattacaggcacgcgccaccacgcccagttaatttttgtatttttagtatagatggtgtttcaccatgttggccaggatggtctccatctcttgacatcatgatctgcctgcctcggcctcccaaagtgctgggattacaggcgtgagccaccgcacctggccagtatttcttaaaataaaaagaaatttgaagaaaatatagcaaaaaatatttatcttaaagtggaaacacaggcatctattattttatattctacatttttctgtgtattaaaagtgttttacaactttaaagtatcttttcaaagatgaaagcaaagtccttatcaaatttcaaaatatgtttaagatcagacatgaaaaataagttaaactttaaattgtgttaagttgccatatttataaaaccagaggcattactaatgtaatgtctagatgataaaagaagatcttgcttcaatttgcccagttccaacctctctttcttcatctaacggtgttaattcacgtcttcgtgccaatgttctgagcttttagctcagcagaatcttgaaaaatccaaagagatatgcataaacgtacaggaaaatagactccagtccacagaggaggatccaagtatctattctggatttaccataagcagcaagcatttccataagagaagggaaacattagcacttagactgcctctgaggagcacagtaaatttctcagagctgagggtgactctccccatagcccctggagggctacatcttcaacttcatgtgacatgtagtgaattatttctcataggaagctgccaggttgaaagccagccaccttgcacatgttgtctcctgaacagcagcacgagacgaaggagagtcaattgccttgagttcccctttgattctgcataaagtcaatcaggtttgccatggctgagtggggacctgaatcagtagcactgaattatctaatggaaacttcatttgtgtgtcccataaacaaatagaaaagttgctattggttgtgtatttttttacaagtagaatacaagtctgtatttgcacagtcagatgctgctataaatctaaagtagctctgtaattccttcagttctgtgagaatccttgtcaggaattggtggtggctagagcgagtaaccacaaagatattctgttacaagtaatattatttcttccaagaagttgctcggctgtgctcctggaagttggcacaggaagaagatttgaaaggactgcaaaagggtttcctggctgcaggctctctccaggggatctttgatggtaacacctcaggttctgagaatgggtgtagagagcagcccactgtgtggctggcttttctggatagttgatgccaacccttaattgtgttgctttttttttttctaaaatatatttttcacttccaggatctaataatcaaagtacatggaactcaatttcactgtactgcaggctcccagcaagctgtgccctgatgcttccttcagttgctccatctcttctgctcaatagtgttcttgctgttataactacagatttccttggatgtttttattccaaccttccttttctaatacttttgaaaacctgtccataccttttctatttcttttcgtgtttcattgaaattcacaccctgatttccactgaagaaagtacttaattcagcatcttctcttctcttatctttctcaaaaaagtgaatttaaaaatgcagttgctttactttcttatcagtgtaatatgactgcctttccccaaacataattaaaaactgaaggtctttcctaatgagttatttttaagtcttttgttaagtgttctatttcttaattttcttcattttttaaagcacttgatgtcattttaaaaaagctttaagaatctgtaaactcgccctctgtgtacactttaatttgcccctttacttgagctctcatcccactctagcaaatggaaggtattgatgcatgcatgacaaactgttttttaatatgaaaacatcctcaccttgaggacttggtggcttctgtggccaaaaagactcattgctctatcccatccatgaagaattcttgatatttcagtttctttattacttacttttcaaagattcctccttaatagttaaattttttgtagtcttgtctagttctagaatcttgataatttaagttttacctatatgtgatatattatttctagagtttacaacatttacatcatgctaggtttctgatatgcagagaaggtatagccaaaaaacaagtaacagtttaaaaagaaagaagaaaacaaatagcaatttaaaaaaaaagaaaagaaaaaacacatagaaggtgtggctgatttatagtgccatcaactgcaggaaccagatgtcctaatttggttaaaacagtccttgcttacacaagttgccctggcactttatctggtttagactttgtcctacattttttagttttcaaatgaaatattactattaatagttgtattaggcaaatctagaatggccacgtagacaactctttccatttctaccatagtcttatcaaggtatgcgagatgcatgagcaataaacagaatcctttttttttttttttttttttttttagaattctcttttaactgtatggttaaatctgtaagaaaaccaacaataccactctcttttctccaaaacttaaaagacacaatataactagcaccttcctttcaagggcagtatgcaacctggtcactgataaagatatgtacttggataggagtagtggagatggctaacaccttccagtctcaggtgggtgtgtgagaggcactgaaatctacagctcctaccagcacctcttcccaccatatccagctggtagggtcagtggagagcacctggaagtgtaagttaatgcactgacacattaggagaagaagaatttctcagagttaaaataatgatatcagtcttatataccagtttataatactggaattacattagtttatcaaatgctttcaacagaacaccaattaaattatttaaataattttaattttttaatccagttcatagaattagcataagccttttaaatttgtttgtttgtttgctttgttttgcggaaaggatctgagtttgtttcccaagctggagtgcagtggcacaatctgggctcactgcaacctctgcctctgccctgtgggctcaaactatccttccacttcagcttcccaagtaactgggactacaggcacatgccaccacgtccagctaatttttgaatttttttttaatggggacggtgtttccccattgttgcccagctggcctcaaactcctgagcccaagcaattcacccaccttggcctcccaaagtgctggaattacaggcataagccactgcacctggcttagcataagcctttattttatttcattttttatttattttatttttattatttttggaaacagagtctccctctgtcacccagactggagtgcagtggcatgatctcagctcactgcaacctccatctcccaggttctagcaattctcctgcctcagcctccgagtagctgggattagaggtgtgtgccaccatgcccagctaattttttaatttttaatagggacagggtttcaccatgttggccaggctggtctcaaacccctgacttcaaataatcttcccaacttggcatcccaaattgctagcaatataggcatgaaccaccatgcccagcaagcataagccttttagatgttcattctgtccaaggtaaaactctgatattattttaaatcctgtcataatctaattaagtagtaaatattaaagataaatatatttattttgtggaaataatacaatacaatttttgtgaagtacaacatatgggttaaaaaaaacaaaaaatattcttactaagttaaaaaatacatgaagcagaactgtatttggaattcaagtgcacaggaaacttacaactgcatcctaataaagccacactattttaccaatgaaaacagaaattcaaagtgttttcaaaatctatatatttagagtaaataaaatagaatatttttgtgatgaggctaatgttgaaaacaaaaagaaattcatcatgaaagaatgtacattttctctcttcccttcccttcatcaatctgagttctgactatttcgacctttgaagaactgctttgtaaatcaacctaagtttcttacaatgtctgtgagtatttttataaatgaatcttctacattttagttgcgttacattcaagatcaattgaaaaacttaaattgattattcaacaaaccaaagcacctccaaaaaaactttcaaaactcttcataaattgcaataattgaaaggttacagaaaacattgacatatctcctcacaaaagcaaaggaagacaaatgagaactcaaaatgttgcacaagaattgattttttaattttataatttccctttgagatatcttgacttgagaaaagacattttagaatggagccccagtttttaattggaaaactgtattttctgcaccagaaggaatagaagttgatttgagaagtcttacaattttgtagtgtctatatttggtgaaaagaatcataaatagatactatttatgggttttgtcttatgaattttttgccaaaaaaatgctactctgtatggaggcaaaattacagtatctgggaaaatatttgggctaaaatatactacacatatcctccatttagcaaacttgcttggcatttacacacaaacacacacacacacactcctgagagttcagttttcctacatgcctgtatgcctgttaatgttagagtgctataatgcaaccaaagcttggtttaaagtaattagtatctttaatggactatgaaacaggagaaacaaacatcatacgtgtacattagaattgggagaagaaaagattgaggctttgatcaaaaccaaaagaaactggaaagaatattacaaaaatgagaagtctatacagacagccagttactctgccattagggaggaaacaaaatctttgcaaaaggcagatgccgatttttggggagtggcttggggacagaaggcattggagatagattgtgtggcttctcaaatgcctttctaatgatgcaatacatattcttaaggaaaaaaaaggattctagcagcaagaggagacagtatatcttttgatatatagggagaaagggcatgtctgtatgcctaaggacaaacacattatttaaaatctcatgctatttaatattacttcattttttactgaaaccaataacaacttatttttcagaccctatgaatccaggttatttctgtattttttaaatttcctctttttggctcattgacaatatttttagtagtcctttttactaaacattttttcattttatggtgaacggatatttttgttaactttgctcttatgcattctattttaaacattagtattatgtgtattttttacacacttattcatatggcctatgttatattttcagttgatttcataggtggacttgatacacactcctactaccaggatcatgttgagttaaagcctgttaaaccagtaagtaaaggtgtgatgatatggaaaatattaatccttctaactcagccaaaactaaccaaaagtgaaataatttgaacctactactactaatcattggtttaattttccactcatatttaaaacacacctttcacatgtaacccaacatcatcattattattattcattccaaaaaggatttgaagctggtgacatgatttatatttcaaaaacaatagttctgtcttattccccttatcaatagttggtaactacattttttaatgagattatttaatctgcagaagtaaagaatgaatatgtgtcctggggcagcacagcaaagtaaaaaggggagaaagacctgcagtgaatccaggtcctccatgtgacatccaggtgccttcctcagtgtctctgagacttgttctatcaccatactatggtttcacaggggggaaatagattaaattggataatgtgtgtatgatatatgtaaagctgcctattactcttcccagtactcaaacatttgactaacaagttcaggaacaagttttctatgttcttagaggacatgaaaggaagtcagcaacaacaaaaccacctaaaactggtgagatttcagttgagtaaaagaaagaaatcttaagtcacctaattaataaaatactaggaaacatggaaatagatagggtgactccattcctagaaaattccaagtagcacatataaaactgtataaattaataatagctatcatacactaaccactttgcatatattatctcactaaatcttcatgaaaacactgcaatgtgctaattaatattcccactttataaataagaaaactgaggttcatagaggttaggcaactttctcaaagtcccactattagtaagttgtggagctgagatctttcctgggtagcaaaccatcacccaacctgatatgatggacttgctcagatgatctttttttctttcagctcagtgttctgtaatttgatggcgatagaagaaattatgtaaaatagtcgcttgtataataaacacatatgaaaagtttcacctgctgcctctttgccacagtggttcttacccaaatatgcagctccctcacccagcatatgtgaggattgaagatctgagaaggctacactgattcctctacctccccaggttgaattaactttattctggcagaatgatctaaagtaaacatagctcacaggaaacacaaatcagcactgtgcctgtcacatgatagatgtttaaataaattttggtttcttaaagcaaatccaatttggaaagaacattcaccctatataacactccagaaccaagcagtcaccacctcattactcatatcactaagtgctcataaaggatatgttccaaaagttgatgtttgtagatatggggaacttgtcagggattgtgacaataatcaagatgattagtgcattgggagtgagaaaagaactaagacaatgcctagtggtgacttaaagagtcttcatatatttgttatgtgataagaggatgatgaagggtttctttcatctccactgtgaaaaaaaaaactcagcagagaaattgcaatatgaaaaatgctgcaatttaagagagatccttctattagggaaagttattaaaaactccatttgataaatgttgataatgaaattttcttcttgaatgatttgcaaaaacttgacgcccatgtacctatgtacctcaaaagggtgttctgtggcatggcccagaggcaagtgacttccacttatgttctctaaagtcacttccatctctgtgaatcaaaaacacccaaaacatacttttaagatcacctaaaaggctttgatcaactccactgtctgctccaagggttttctcagcacccctgttcactgctgacctagcagtggatagctgaatatagcataaactacaagctattctctacagaaagcaatagaacaagcttctgctttgacagattatgcatattatcatgtcagatgaatatggaatgcctttcaaccatgaaggaagcaaaaatctaaaaatcaaactaagactgaattgaaatcattgtgcatgaaacaatttaagaggtcagtatctgtactcttcaccagtatgcaaatatttcagcatttatccagtctgcctctgtcaatctacttgatttcttttaataagcccgttatattgaattccattgaatccaatgatgccatatcactacccagcaacagcttggagaaaaagccaaccttctgtgcgaaattgttagagaggggaatgaatgctggctttgactttcattaagcctcttttatcacagtgaagtagaaagccaggttttgtgaggaagccactttaataaggggatcagaagaatccttagcatattcccaggtacatgtatgtgaacaggtagctttgaactccatatgcagagtttccagccaacagctcattcctaggtaatactgcagaattgtacaggaagccttaattctcatgtttgagtgtgtcactgctcataaccacaaagtgcacctttcaagtgtccacagtcaaattgtatgggaatgtgtataggggaagtggggttgggataggggtaaggtggttcacatatggatttggtctctcatgttttgtttctttctttttaaagtaatgatatcaagctaaaaaaaagcccactgattacatcaatcagtttaattcactttactatcactgattgattgcctacactgtgcacaacaggcacagcctaagtgctagagatataaagataaatgatacttgagatttgacccttagcagccaatgatctaggaggggagatctacatagaaagggtagatgcaaaacaatatttatccccaaggaaattttatgcgggagggggaatggttaactctcgcttagcgaggaaaggcttccctgagaaataacaattgagctactttgaaaagatgacacaatttatcaaaagcagaataaatataactatattggaagatactttggcagtttcttacaaaactaagcatacttttaccatgagatctagcaatcgagctccttggtatttacccaaagaagctaaaaagttttgttcacacaaaaacttacacaccgatatttatagcagccttttttttttttaagacggagtcttgctctttcacccagtggggagtgcagtggcactatctcggctcactgcaagctccgcctcctgagttcacgccattctcctgcctcagcctcctgagtagctgggactataggcgcccgccaccacgcctggctaatttttttgtatttttagtagagacggggtttcaccgtgttagccaggttggtctcgatctcctgaccttgtgatccgcccccttcggcctcccaaagtgttgggattacaggcgtgagccaccgcgcccggcctatagcagctttattcataattaccaaaacttgataaagaacaaagatgtcctccgtaggtgaatggatgaactctgggacatccataccatggattatttaatgctaaaaagaaatgagctatggcatcatgaaatgacatggaggagcattaaatgcatgttatgaaatgaaggaagtcaaactgaaaaggctacatgctatataattccaattatatggctttttgggaaaggcaaaactatggagacagtacacagatcaagggttgcgggaggggagacacgaataggcaaagacagaggatttttagaacagtagaactactctgtatgacattggaatgatggacatatttcagcatacatttgtccaaacccatggaatgtacaacaccaagagtgaatcctaatgtaaacgataggcttcgagtgactatatcagtgtagattcatcaattgtaacacatgtaacacactggtagggaatgctgataatggaaaaggctgtgtgagggcaggaacaggggcagggagcatttgggaaatctctgtaccttcctctcaattttgctgtgaacctaaaactgctcttaaaatattaagtctttaaggggaaaaaaaagcagcacaagaaaacgggtatccccagcatggaggctgattggcttggccgttctacagaagacaaagttgaagctcatgactccctaatctcatgtttgccatagttctcgtataaagtgagtgaacggataggaagcagaggcttaagcagagcaggtgtcttgacagctctcggtgaggaccctaagagacctgcagcagccagggctccaccattatgcctaaagctatcgagatgctttcagtggtggttatctgggtctggcctggggacatgtgatacacaggtcaggagtcatccgtgttgggtttcaatatcttaccacaactgctatcgagggaggtataagtctcaccataactgccatggagtctccaccgggatctactccatcaccacccccactcactgacagcaccaccaatgaaaggaaagagtaaagactgctcttatcatcagaacccagaacccagtggtcagcagcagtggctctgaaaaggatacctacacatcagcttacagtaggggcagcagtaacaccaggagaagagggttagcaaaagcagatttacccctcaggaagaaaaatagcatggcataaacatatacagctatcaaagagatatggaatttcagagaacaacatagtgagcaactaaattgaagtttgtcaaaatcatgactggtgtatttccatccaaatggttagcaactgagtaccgggaagattaagctccatgtagcagtaattcttcacataaaaataattagagcaaggcagtttatcaaagaaggacagcagctggaattccagaactgacttctacagcaaaggtagagctagatctgattatgttagaaatttccatgaggatgatgcctatgactgcagttaagaaagacttgatgagaaaagctgacctgagattcccccataactttcagcaaatctttttctaaggcttccaaaggaaaacttgttttctttggtatcttaacttgtctgattgcctttgctggaggctaatttttcttcacaaaaattgctacatgctaggtggccactgctgattgagtggctgctattgcaactaggtactagaagacagccaaggccaatccctatttcagggtagccctgcagcgagctctgcaggtactttcactgcctgctttctgtctctgacaatccgggtacacaggaaacccacctctgatgatcaggctgtaggacagatgcagaggtggtcacgtctctctgcactttcctgagaacagctgttttgcattagtacccctatatgtaagttgatgtcaggccattttgcatttatagcatcaacattaagtaccagctagtaggacaaatcagggtgtgtgtgtgtgtgtgtgtgtgtgtgtgtgtgtgtaggagttgggaaggtggagtaatgtgctttcaaaccttgatttaaaaaccagcaatcaccagccatgtgttagtaaactgcagctggaggcacctaaagaggaatagaataactctgtcttgatactgttttcatttgtccttaattagccttcacatcttatatttatccagatagagcacgcactgagctatgtcaaattctgcatgctgtttctcttctgtggcatgtgactataaggtgactgtgatccgctcctatcagtggctgtctcactgttcccactactaagggtggagccccgttccctgaggcttaccatcagtccctggaaatggaaaggacttcatgaggcgttaactttcctgggctgtctcaagagcactgcagctgtaaagcactcagcaccttcttagttgtcccgaaggagagatgggcttccttgtgtgcctgccttacttagcaccaatgcagtggcactcaggactcgttgctttctctagctttggacctctttccctttgtcactgacattaataactttttgatgcatcataagaatggttgtaccatgtcatggactactgtaagaacacatcctgatatatacttatttgactatgtagcagtgaaatggctgtgtgtatatagcttacgcagttcagacttatcaccgtagtatccagttagtgcacctctgtttttattaggacggaatgatgccaagagtgcaactggcaacatgcaagagggtttgctgtgaccagtggccagtcacgtgtcaaaggaaacacagatcatttcctttgacatgtgacttcactctctgcccctaaaatttgtggagcctgattctcatgcttccttgtgaagcacataaagcctttttccaaaatcagaaagcccatatctgaacagtgtcctccagggagaatatcaattcctgactttctcagaactttgctgggtatttgccattgatttcaatggcaagaaaatagatttatgcagtgatgtggagatatagtccaccaccacccctgaaaaaaaaaatcaacaacataaaaaaagtcattttgccctgtttccaagagaaagtatcctctgattttaaaattaaagccaatgatataaaccaaattttatgttaaatacacatattttgcacttaatattgacatcaaaaaaatttataatccccatattatgataagttctgggaagaaacaatatacaggaaagattacacaatacgcaggaaaaaagcacacacacacacacacacacaagtgattagaaaagcaatagaaaaagaaacatttacagttctatcagaagaaacacttgattccattctgccttgagggcagttacccttaagtaactactaacatatctacaaacgtctgcaaacagagagagagaaaaagagaaagaaagagggagatgatctcaaggatccccaaaatcgaagtattctatgcagacccattgatcaatcatagcatcattaaaagtgggacaaccaggccgggcatggtggctcatgcctgtaatcccagcactctgggagaccgaggcgggcagatcacttgaggtcaggagttcgacaccagcctgggcaacatgatgaagccttgtctccaccaaaaaataaaaaaattagccaggagttgtagtgcgtgactgtagtcccagctacttggaaggctgaggcaggagaaccacttgaacccggaggcagaggtttcagtgagccgagatagtgccactgcactccagcctaggtgacagagtgagactctgtctcaaaaaaaaaaaaaaagtgggtcaacgagacattttgtgtccacagatgtgctacaataagaagtgcacagcaccacctatagaatgccttgccataaagtcaagcctgaccttggactgatactatagaaatacaagaatagttaaatctcaccacaaggaagcaatcagccaaatctagcatgtgagaaatagtataaagcaaataaaaaaagaagaagaagaagaaaggaagggaaactgttattgatttaaagagacacaatagtcaaacacattgtgtatatgtggtttgcttggttttaaaactttttttaaaacagaactagattatatttcaaaacacaacttctgtataaccaaaaaataaaacaccacaataaaatgaatgagaaaaaaacatatttgcaattcttgacaaaatgttaacatctttagtcataaatgaactcttcagaaatcagtactaacagactcacattacaagggaagtgaaaacaaaaggaaaagaggaaaatggaatagcacaaatgagttataaggctatatgatcttcatcttgatatggttaacattactagatgagaaagaaatttcattataaattacattatcgatgcttacaaatattgatatctgatgtttgtacagctttaggaaatgaagaattctcaaatactggggcaagttactctagtcatggggagtttacccaaaaatgtagatttttgcataaatttggcccaggcagttctcaacgataggaatcactccaacaaatagttggatacacacccacacacatgcacatacatgtttactacatagaaaatgtgtaagtaatctattatcccccaagaaactacttatgtatccactggtttatgaaataatagactgggggtagaaatagaaagaaaaaagacacttaagtaaaaatactacatttcacaaaattctgtgtcctttgaattcttatgaaagatttttaattaatcagttttatatttaccttgttattagtgaaaattataaatatatgcacttcatagtgatgctgccagacatataaggcataatttcaacaaaccaattgtaatgagatatttccagatgattggagcaagtgattatgggctgagtattaaatgatattaagaaatttttgtcaattttgataggtatgctaatgaataggtaaaaagaagaaaagaaattcttaccaattgagcaggttctttcaacctctacacttttgactttggacaaggtaattctttgcagtgggtctgtgccactgtgggatatttaacagcattgttggcctgtaccgcctagatgccagtaacaccattccctaccaaactgtgacaaccactactgtctccagatactggcaagtgtcgactggttaagaatcactgagttagagacgcatggagatatgaatgaaaggatataatagttgagatttgattttaaatactctagccaaaaaaggctgtggggggtgctagttgataggtgaaactttaatagcataacttttattttagttgaagctgagtgatgaatgcgtagagattcataatactattctgtctatctttgtgtctgaatttttttttttgagatggagtttcgctcttgttgcccaggctggagtgcaatggcatgacctcagctcactgcaacgtccacctcccaggttcaagggattctcctgcctcagcctccctagtagctgggattacaggtgcctgctaccacgcctggctaatttttggtatttttagtagagacggggtttcaccattttggtcaggctgctctcaaactcctgacctcgggtgatccaccagactcagcctcccaaagtgctgaggttacaggcgtgagccactgtgcccaaccctgtttgattttttaaaattcaatctgttaataaaacctaacacaggtttgccaataggttttcctttgaatgccctctttcagagttgcctcactgtcttctgcaaaaactccccacagacatgtttcccagctcctgaagtaacacttccagaattcctacctgacatcataagaacaggctcagcctgtttcactgcttcaccaatccatgttgctaaagcccagaagcagaaaatattagctagaggcagagctggtgttaaagataaatgtaatggatacctacaagttcccccaaaccctcactgacactactgctaacaaagaaaaacaccttctcctgttgccttatcctcactcttgaagggattcatgtattggatggataaataaaccttgaaaattccttctaacgtaaagattgcataaagctataaaattccaccattataatcccatccctttctcttttagtttaaatccctgttaacatgccaaggagtagaaagggtagacattgagattcagaatgtagagaatagatgagcagaggaaatgtgatggggcacagggagaggcctggaggattcccactcctggggcgtgcaggagggagttgttctctagatgagttctaggcgcttgggtgggtatttttttagtcgttttcttcatgctgtacagcgagaagagtggcaaccaaaaagtaaaacttttgggaaatttttcagccattccaaattataaccaaagagttcactccaaggcacaaagtcatcaaactgaagtagaggaaaagaagttgctagatgtggttatgaagtgagtgtgaaacgcagtctgttggaatgatgcttataatttagttgaaggaagaaaacttgcatgcctgggtaaagtaattaatcatgaggcctggatgccaccagctgacatggggaagagctgatagcctgagagttgctcttagcaggatgagaaagcaaaatggctgagggagaactggaagtcttcttcacagtagagaagaaatttcagccaacattcaaagttgagtagggtttggattagctaagacttttcataggagagaaactgtgagagcaaaagtgttcaacagatgtttatgaagtatcatctatgtagtaggtactgtgttgaggttgacattgtgcaaagatgcagaaactgatgccctaacattccaaaggcttacagcttaggatagaataagtagagtcattgtcaaaagtgtggagaaaacagtgattggagatggggatctgtatgagtcagggttctccagagaaacagaaccagtagagaaagagagagagagagagtgtgtgtgtgtgtgtgtgtgtgtgtgtgtgtgtgtgtgtgcttccccacacatgcgtgcatctgggggctggcagactggagacccaaggaagagatgcagctcaagtccaaagacagtctggaggcagactttcttctaactcaagagacctcagtcctttctcttaaggccttataccgattgcatgaggcccacccacattacagacggcaatctgctttactcaaagtctactgatttacgtgttaatcacttttcaaaataaaaaatttaaaaaaaaacacctttacagcgagaggtaaactgaagttttaccaaacatctggacaccatggcctggccatgctgacacataaaagtagccatcacaggatgggatgtgtgtaaggaacataagtcaatgattgggtgttatgaaagcaagagcaggatgatcttgagcacttaactacccagcatactgtagaaagaacaggctatgtgaatatctcatagtttgcgcacacaacactaccctgttatctttacccttaagaaaagcaatagtgactactccatatcacacaacaattactgtgtggttggcacttctctcccaggaaatcatcctgaactctgatgatgatgcccgattaccatgccctaatctgaaaagcaggaaggcccaagtctttaactttcttattgctacagtcagacagcaccaggtgcacccaggagctattttgcatttcaaaaggcctcaatgaatataaaagatatttagctgtcagctttgaagttcttgaaagcaattcgtattttctgttttaggtcgaaataagtaatgacattgaaccagaaatgcggctgctgaacttgacttagggagcaaaggaccattgactgcgcgcctcggtggatccgacccgcctgacattccttccagaggctagactgtgcttcctggctttcccacgaatcatggagcattttggtcacagcctttgtattattagcattgttctctagatgagttctaggtgcttgggtgggtatttttttagtcgttttcttcttatatgaacacttgtaagttgtaaaaaaaaaaaaaaaagaaaaaacagaatttggttttaaatttttaacaatatttaatgtgaggcatgcaaaatgaaaaagcaaatctgtgaaaaccttctacagtcaattctaagagaaatctcagtgtgtgctgtggagatgttaagtcagcactgctgactgttgaagttattctaggcctgatgaatttgttttagcagacattacctgtggttatcagccaccaaggtagaccctgtgacagctgataaataggtacaaataatggatccagcttttggattgaatatgggtcattttttcaacagcataaaacaaaacatggagtcctcctttgttcctgacttcttaaaacccagaacgatattatggcaatctaaattttcagattcgtgcatatcttgtttttcctgatatatatatatatgtaggcacatggaagagtaaaaggattagtagaacccctttcccctttggagggaatatgggtgtctctgaggtccatattttctactcattattccattcctgacactgctgtcagacctaaacatacagctcatgggcttgtgggacagaaatcacaaacatagacctgcagtcaggaacttttctcttaggatattcaaaagaagcctgaaaatgctgtagcattctctataaatacttctaaaggagacattcacgtgtgagcaacatcagcttttctttctcctaccccttcccaataaccaagaaaatgatatgggaagcaattatctgtggaaaaaaggactgtcttgaaaacgcatcacagttgtatttttttaactggcataaaacttacatatggtaaaatgcacaaatattaatggtacgatttgattagttttgaaaaatgtacatacccatgtaaccaaggcctcaatcaaaatgcagaacatttccgtcactttaaaaaattcccttatgccctctttcaggcaatgcctacattctcacagacaaccactgtgctaattttcatcatcactgataatttggtctgttctcaatataaaatatatacacttttcacatcacttttgcccacacttctcaatcactattttttatatgaaaataagttttgctcactttgtgtaacgaccacagtgaagctccctataggccagaaagttgtgaatatgtggttattaactcagcccatgcatctctaagaagtccgtctattaaccacctaaaactgttacaaatatttgtatgtgtgtgaaagtcttttttcttcttgttcttctttcggagcctataggtttcatgagactctgttaagaatcagagtttaatgtgacaaagtttgccttcattcctccaagctcatcacaaccacagtgagccatttggagacctaatttactcactagcctccagattttacccctttaatccattggtacccacaaactcccattacttttttttctgcttaataaatccaaattcaaataaagaaaagctggcagggaccttgaagatggtggaatccaagccactattctgcagatgagggggctgaagcctaagggatttggtgaacttgtccagagcctgtatctgtacacaggggcaagagccatagccagtggacagagaacatgggagcaaaagttggggtttgggtcccatccaccaccatgttcttggacagtgtttgccatctctgcactacagttttcctcatcaatgaagtggaactatgatccctacctcccaaaggtgaggtgagaatttaacgaaaaatgtaaaaaaattctcagtacacagtgaagcactccacaattaaaggaggtgattattattaataatgtcaaaacactcctctgtaccctgtctggagctcttgctttccactcaagcgctatgaagagcccacagaaacaacaaactctgttttttaaaaagcagctgggaaaaccttgcccaagtttaaatgatttgaaataaactaaaaaatgctttaatttaaaaataacattaatattcaagttccaaaactaatgccaataattattgttagtattgttacgattattgaaaaagctgataaaacatcaaaactgtagagagtcagtaaaaaaggataaaatgagtattgacatattttaaactgtcacttaattacccccacacatacacatgcaaataaaatgtggttaacatttcacaaaatagaaccatactaaattttgtttctattttatcttcacgtgaatttgtacatagttctagtaggcactgcagagtctgaacttagtctaagtgcagataacagctttgaggaaaaaatccttaccttagtgatttgtctatgaatattcaatgtaggcaactatttaatatggtgtatatgttttcatttttaatctttcttcacttaaatatgaagttataactgtttcaatctccaacctcagcaatccataaagattgtcctaacattctggatatttgccactcatcagaaacaagttagattgatctgccacctcctcttctctcttttcttctccctgcctttcatcttcctggtttctctttgagggctatgcttctgtaagacaaagggaaaaaaagaagtgcagagttgtacagtaatacttggcaattacccgttaatctgggtaattccaatgaagtactgtcacagttactgttccatggaaatgagcatttgcagttattgcttttgcctccagtcttatagaatgcactctgcattgtgcgtatccagtagggttttcagcaaagacatggtcactacatgcactgtatgttcttgccaaacctcagcttctccatatgcaattgtgtgtctggtcagagtaagggaaaatgaatgcatcccttagcttgcattcattggtcagaatcttaactatcttaagagatggtgcagctctagattcaatagctctcctcagaagtggccctggcaaaactgaagataggacatccactgctctttagcttctagtgctgactggaatggtgaacatttaaagccagtgtttttcctcttggagccaccttagcactgagtcttgtaaaccttggccagcccttcctcaggccgtgccttctatcttgtgtgaatgatgcatcctttcttaagcgtcttctgctgacctcgtgcagcaccgcaggaagctgggatgctttcgagcttactttttctttatttgagcttctggtcatgtttcaaagccatcaaaatctaagcaagggagttacagggagggttagagaattaccaaaggacacaaaatgtcttgggttgtggaatagcacacatcagagaaatctcaaacatctcttaggaaaatctctaaatgtgtatatccccaagtatcttagccttccacctaccacataaagtgagggtatgtgtccctcaaatgagaaaaatgaaaacacactttcttaccacttcaaatctgggaggtggttggctcatttgttttgaagatactcgacactttgccctagcaaaatattgacttctttgatttttccttcagaaaaataagccctgttattcctatagacctaaataagggaggcagccagtttcaagaggctggctctaacaaaatataccaaggctgtcatctgtctcacttaatgaatgggaaactcctgattgagaagaatttgtcttcattaaaactagctaaaatgtacattgcaaatctgaagaaaacaatcatgactctgctaatttgagaagcaaaaaccaaaatttctcttttcaatctttgcaaattaaaaaggaatcttgccaagaataaacaaatcttcatttcatacctaattttaaaacgaattgtgtccccaaatatggtctattctggctaatcattttttaagcaaatcctcacttactttttctgagtcactttagtatgtaactaggataaatttcatagttgatcagaatgcaaatgttctaacttgacatttttgcccaagatacgttctttccaggtatagctgaattaagtaggaaaaatataaataattgctcttttaaaactataacaacttgaatgcctgcggttttatttccatctaatttaaaagttatctgtaacctttgtttgatagaaggtctgttgaagtgtctaagaaccatgttgaaatatttgtgataaataggccacaacttaaggatattatgcccaaaagtgaactgacagaggaaagtactcttcatataactgcacagtgaacaatttagaaagggaacagatgaccagacacagtggctcatgcctgtaatcccaaagctttgggaagttgagatgaaagaatcacttgaggccaggagttcaagaccagcttgggcaaaatagtgagaccgtatctctacaaaaacaaacaaataaacaaaaaatacctaaaaaaaaatttaaattagccaagcatggtggcatgtacctatgaccccagccacttgagggactgagggaagggaagattacttgagcccaggaattagaggctgcagtgagtgcactactgcactccagcctaggcaatacagcaaaagcctgtctctaaaaagagagagagataagtagatatgttttaattattagaagaaggtatttatcaataaagaattctcaaaaaaatggaattatcaaaaaattcaaaagttatgggtagcatctctttttcatctgaaaaagcttagtttcttattgaagactaaaaagaaaaatgccacttcttgaaggtggatacagcttcttaaatattggtatttgtagaaaaatttggtggcaggcaaaacttgaatcatctttcttgaacttgcattcaaataaagggtaaaaatcatgttaaatgctaaacatttttaaaaactgaaatatttaaagaatccaaaatatgctttagcttaaacttgagagctaagttaagtaaaaagaagaaaagaatagaaggtagaaaggaagggagaggaaaatggagagaagatgaggaagagaaagagaaagaaagggaatggacaaggagacaggaaggaagaatccaaagttgaaagtcacctaattgggatttgaacagtcagtttttaactcagaattttgttcttgtttctttgattgactaaaaacattgaatcattttccatgtaaggcatgtttttcctttcctcttcagagttatttagaaacagttcaaagaaaccaataatctatccatttcttctcatagaatttgctttggcagacaacttagtctatattagttaggattaggtttacctacaagtaacagaaaaagaaaaatgacaatggattaaataacatagaggtctatttctctttttatttcgaaattctggagacagtcagcaaagagccggatgtgatttccctagagacaaggaccgagactcctctcattgcttcatcctctgtggccgccatttttaagaccataacatgactcaaaatggctgctgaagcttcagccattggttttgtattctggccttggaggtggagaaggaacaaaaggaatgtttctttcctttaaggatatgcctcagaaatacacacactacttctgtttacatctcattagccaaaacttggtccacccccaactttgcagtgaagaaacctgggtattatagtctttattcttaatgactttatgcttaactaaaaagtaagagctttgctggacatggtggcttatgcctgtaatttcagcaatttggaaggccaaggcgtgcagatcacttgagcttacgagttcgagaccagcctgagcaacatggcaaaaccccatacctacaaaaaatacaaaaaccagctgtggcggtgtgtgcctatagtcccagctacttgggaggttgaagtaggagggttgtttgaacctgggagacggaggttgcagttagccaagatcatgccactgcactccaacctgggagatggagccaaaccttgtctcaaaaaaaaagcggggggggcttcatttattagtaagaaggaaaaatatttataaaatcatacttagcagtttcaatcacacagttcaaactaattgacatgatttcttggaacagtgttttcatttgtagtactttataacacattctagaaaaaatgtacatatattcttcagtactgtgagagatttaatcatcaagtatgtgaaatgagaatttctgcctcatcttgtttccttatcttgtctttgtggttagaaagaaatgaaaataaatcagtagcactacatccttctaggtttcccataattttgcagacaggtttagcttttcttctctagaattgagtttaaaattctagagccaatctaacattttgcttggtcctcattgtgctgccacaataaattaattcttctatggtcataacacttggctattttattttggtagggccttctcttctgaattgattggtagtgttgttattttcttgttattcagtttaacaagtacataatcaacatcagtgcttgggaagtcaggagtacgagagataaataagaagtatatgatcttttctcttattttctctcagtataagttggacctgtttttcccttcatctctttttcttcaagaacataatatcggctgaagtggaatgagtattcaaattgtccaaaaaaatatacaagtgagggaattaataaaattttttgtaattataaatatgtatatattggggggcaaaatatgactttttatttttatttttaaccaccagattgagtatgttgatacatcaaatgccagtcttttatcttcctagtttttcaaatagaaaagtgatactaacatcaataattaaacttcccaagatttttttgtctctctctgaatcaagttcgtcgtctatttacgtgcttctcagttgacatttgtgaaggcagattatacacatgagacagtggtgaataaatccaccccaaaattcctttgcagatcttgagtatttgccaatattctctatgatttatttacattcttttttcatatatatactttaagttctgggatacatgtgcagaatgtgcaggtttgttacataggtatacatgtgccatggtggtttgctgcacccatcaattcatcatctacattaggtatatctcctaatgttatccctccccttgtcccccactccccaacaggccctggtgtgtgatgttcccctccctgtgcccatatgttctcattgttcaactcccacttaagagtaagaatatgcagtgtttgttttttgttcctgtgttagtttgctgagaatgatggtttccagcttcatccatgtccctgcaaaggacattaactcattttttatggctgcatagtattccatggtgtatatgtgccacattttctttatccgttctaacattgatgggcatttgggttggttccaagtctttgctattgtgaatagtgctgcaataaacataggagtgcatgtgtcattatagtagaatgatttataatcctttgggtatacacccagtaggggattgctggatcaaatggtatttctagttctagatccttgaggaattgccacactgtcatccacaatggttgaagtaaattacactcccaccaacagtgttaaaagcattcctatttctccacatcctctccagcctctgttgtatcctttttaatgatcgccattctaactggtgtgaggtggtatctcattgtcgttttgatttgcatttctctaatgaccagtgatgatgagatttttttttacgtttgttggctgcataaatgtcttcttttaagaagtgtctattcatatccttaacccactttttgatggagttgttttttttcttgtaaatttgtttaagttccttgtagattctggatattagccctttgtcagatggataggttgcaaaaattttctcccattctgtaggttgcctgttcactctgataatagtttcttttgctgcacagaagctccttagtttaattagatcccatttgtcaattttggcttttgttgacattgcttttggtgtttcagtcatgaagtctttgcccatgcctgtgtcctgaatggtattgcttaggttttcttctagggttttaatggctttgggttttacatttaagtttttaagccatcttgagttaatttttgtacaagatgtaaggaaggggtccagtttcagttttctgcgtatggctagctaattttcccagcaccatttattaaataggaaatcctttccccattgcttgtttttatcaggtttgtcaaagatcagatggttgtagatgtgtggtgttatttctgaggcctctgttctgttgcattggtctatatatctgttttagtaaaagtaccatgttgttttggttactgtagccttgtagtatagtttgaagttaggtagcatgatgcctccagctttgttctttttgcttaggattgttttggctatatgggctctttttggttccctatgaaatttaaagtagttttttctaattctgtgaagaaaatcaatgttagtttgatgggaatagcattgaatctataaattactttgggcagtatggccatttttacaatattgattcttcctatccatgagcatggaatgtttttccatttgtttgtgtcctctcttatttccttgagcagtggtttgtagttcttgaagaggtcattcacatcccttgtaagttgcattcctaggtattttattctctttgtagcaattgtgaatgggagtttgttcatgatttggctctctgtttgtctattattggtgtataggaatgcttgtgatttttgcacattgattttgtatcctgcaactttgctgaaattgcttatctctttaaggagttttggggttgagacaatggggttttctaaatgtacaaccatatcatctgcaaacagagataatttgactttctctcttcctattcgaatacgctttatttcattctcttgcctgtttgccctggccagaacttctaatactgtgttgaataggagtggtgagacaagccacccttgtcttgcgccagttttcaaagggagtgcttccagtttttgcccattcagtgtgatattggctgtgggtttgtcataacagctcttattattttgagatatgttccatcaatacctagtttattgagtgtttttagcatgaaggagggttgaattttgtcgaaggccttttccgcatctattgagataatcatgtggtttttgtcattggttctgtttatgtgatggattacattcattcatttgcatatgttgaaacagccttgcatcccagggatgaagctgacttgatcatggtgggtaagctttttaatgtactgctgcatttcttttgccagtgtttcattggggattttcacatagatgttcatcagggatattggcctgaaattttcattttttgttgtgtctctgcctgggattggtatcagaatgatgctggcctcaaaatatgagttagggaggagtctgtcttttctactgtttggaatagtttcagaaggaatggtaccagctcctctttgtaactctggtagagttcagctatgagtccatctggtcctgggcttttttttttagttggtcagctattaattactgcctcaatttcagaacttgttattggtctattcagggattcaacttcttcctgggttagtcatggtagggtgaatgtgtccaggaatttatccatttcttctaaattttttagtttatttggatagagttgtttgtaatattctctgacggtagtttgcatttctgtgggattagtggtgatctccactttatcactttttattgtgtctatttgattcttccctcttttcttctttattagcctggctagccatctaagtattttgttaatcttttcaaaaaaccatctcctgtattcattgattttttgaagggtttttcgtatctctttcagttctgttctgatcttagttatttcttgtcttctgctagcttttgaaatagtctgctcttgtttctttaattcttttaattgtgatgttagcgtgttgattgtagatgtttagattttagatgtttagatgtttcccactttctcctgtgagcacttaggtctataaatttccttctaagcactccctctaagctctatcccagagattctggtacattgtgtctttgttcttgttggtttcaaagaacttatttatttctgctgtgatctcattattttcccaggagtcattcagaagcaggttgttcagtttccatgtagttgtgtggttttgagtgagtttcttaatcctgagttctaacttgattgcactgtggtctgagagactgtttgttatggttttcattcttttgcatttgctgatgagtgttttacttccagttatgtggtcgattttaggaaaatgtgctatgtgatgctgaggagaatgtatattctgttgatttggggtggagagttctgtagatatctattaggtctgcttggtcaagaggtgagttcaagtcctgaatatccttgttaattttctatctcggtgatctgtctaatacacacaatggagtgttaaagtctcccactattattgtgtggtagtctaagtctctttgtaggtctctaagaacttgctttatgaatctgggtgctccactattaggtgcatacatatttaggatagttagctcttcctgttgcattgatccttttactattatgtaatggccttctgtgtctgttttgatttttgttggcttaaagtctgttttaccagaggctaagattgcaacccctgcttttttttgctttccatttgcctggtaaatatctctccatccttttattttgagcctatgtgtgtctttgcacatgagatgggtctcgaatacaacacaccaatgggttttgactctttatccaatttgccagtctgtgccttttaattggggcatttagcccatttacatttaaggttaatattgttatgtgtgaatttgattctgtcattatgatgatagctggttattttgcccattagttgatgcagcttcttcatagtgtcgatggtctttacattttggaatgtttttgcagtggctggtactggttgttcctttccatatttagtacttctttcagaagctcttgtaaaggcaggcttggtgtgacaaaattcctcagcatttgcttgtctgtaaaggattttatttctccttcacttgtgaagctcagtttggctggatatgaaattctgggttgaaaattcttttctttaagaatgttgaatattagcccccaatctcttgtggcttttagggtttctgcagagagatctgctgttagtatgatgggcttccctttgtaggtaacccaacttttctctctggctgcccttaacattttttctttcagttcaaccttggtgaatctgacgattatgtgtcttggggttgctcttctcaaagagtatctttgtggtgttctctgtatttcctgaatttgtattctgtatttcctaagcctgccttgcgaggttggggaagttctcctggattatatcctaaattgtgctttccaacttgattccattctccccatcacttttaggtacaccaatcaaacgttggcttggtcttttcacatagtcccatatttctgagaggttctgttcattccttttccatttttttcttctaatcttgtcttcatgctttatttccttaagttgatcttcagtctctgatatcctttcttctgcttgatcgattcagctattgatacttgtgtatgcttcatgaagttctcgtgctgtgtttttcagctccatcaggtcatttgtgttcttctctaaactggttattctctaaactggttattctagttagcaattcctctaaccttttatcaaggttcttagcttcctcgtattgggttactatatgttccattcgctctgaggagttcgttattacccatcttctgaagcttacttctgtcaatttgtcaaacacattctccattcagtattgttcccttgctggtaaggagttgtgatcctttggaggagaagaggcgttctggttttgggaattttcagccttattggactggtttttcctcatctttgtggctttatctacctttggtctttggcattggtgacctttggaaggagtgtttacatggtcatgctctttgttgatgttgatgctattgctttctgtttgttaattttctttctaacagtcaggcccttcttctgctggtctgctggagttttctgggggtccactccataccctgtttgcatgggtatcaccagcagaggctgcagaacagcaaagattgctgcctcctcctacttctggaagctgtgtcccagaggggcacctgccagatgctagccagagctctcctgtatgaagtgtctgtcgacccctgttgggagatgtctccccatcaggaggcatgggggtcagggacccacttgtggaagcagtctgtcccttagcggagctccagtgctgtgctaggagatctgctgctctcttcagagctggcaggtgggaatgtttaagtctgctgaagctgcgctcacagctgccccttcccccaggtgctctgtccccaggagatgggagttttatctataagcccctgactagggctactggctttctttcagagatgccctgcccagagaggaggaatctagagaggcagtctggcttcagtggctttgcagcgctgcagtgggctccactcagactgaacttcctggcagctttgtttacactgtgaggggaaaactgcctactcaagcctcagtaatggcagatacctctcccccaaccaagcttgagcatcccaggtctacttcagactgctgtgctggaagtaagaatttcaatccagtggatcttagctttctgggctccatgggggtgggatctactgatcaagaccacttggctccctggtttcagccccctttccaggggagtgaatggttctgtctctctggcattccagacaactctggggtacgaaaaaaactcctacagctagctcagtgtctgcccaaatggccactcagttttgtgcttgaaatccagggcccttgtggtgtaggcacccaagggatctccttgtctgtggattgcgaagaccatgggaaaagcgtagtatctggaccggagtgcacccccactcacggcatggtccctcatggcttcccttggctaggggagggagttccccaaccccttgcacttcccaggtgaggcaatgccccaccctgcttctgcttgccctccgtgggctgcacccactgtctaaccagtcccagtgagatgaaccgagtacctcagttggaaatgcagaaatcacccactttctgtgttggtcttgctgggagctgcagacagctgttcctattcggccatcttgcctgggaatctgtaattatattttattgcatattcttcctaggctgggtgtgtgtgtgtgaaagagagagagaaacagaaacagagacaaggagacagagacagtgaaacagaaacagagtcatcttccaggttctacttattaagcaatatcccatgaagtagctgaaaagtgttatattctcctaatacctagtgtttgcaaatctggcagctgtcactgatgatttaaacaagattgggtgacttatttatgtacacacacatccacaatcaaacttcaacagtcgagtgtacccttttctaaataatcacgttgctaaaatgtgccacatggcccatttctttaaacaataaatggtaaattattattttggggagtgaaagctaaaagaaataatatgtctaatacgatgtggcattttctctatacagtacagttttagcattgaaaaggacctcagcaattccatttgccccgttttcagatgaggagattgaggctggtagttacagtggttttgcttcatgtcccatcccactggggctgctatgcaagctctcagtctagtcttctttcctctgcacttggtggccatcagctgtaacaagtcctgactagacaagggctttgttgttgactacaattcaatgccttttttgcctgcgtttgtttggaccctgctaatcaaggctacagggcagctgcagaaagacacctgctattggcttacctgctcctcgccttccctctgcttgggtctgagcatcagaaagccaccttccagtgggtctttgcctagcttttgtcttgtctttgctttttattcatctttgcttttgtcttctcagggcaaataggaaatcctagacctcagatcactgttctttgcttcccaaaagacagaacagctcagtcctggctgccaccttctttctttactcttggtttaaatgtaatcccacatgccctagacaagcctcctgatgatttttcatcaaacatgaaaatagcttacttttaactgctgggtgtcagtctcttctaaaaattttgttcctaaggaattgattttgcaaatcagtgctaaagtcactttttaactgcctcacatactatcatttctttgacaattctttttaaaggggattgctcttttctccttctggtttctcaaatctacttttaacttcaaatagcaggcatgcaatgtagttttataagataatatactaggaccatctatcagatatgaaaccaagcataatcattgcaattatttctactgtattcagataatgataatacaaataagagtacgacatacgtaaatgttgattagctttctggttccttcatcaaaacttgcgttgtgttgtgcagccttttctttgcattgtccaggggttttgttattacaaaccataatatttaacccatttcttctactaatatcttttaatatttatgctattatatagctttttatttttgacatgtatctaaaccagaaaaaaatattccttgtacatgatatttttaggcaaaacataatgtctggagcaccaagtgaaataactgtggagaatggaatgttggacaatttgtgtggcatgcttagcttaatttgtttctatggcacaagcaaagctcattaattccatttattattttaagccacttgtttggtgttatggattttaagaatcagttggtgttagaatttttaataacacagagaaagccattgaatatggaactcaaattatctaaggtttacccagaagtcaaaatcacctggccctctgtaaatttctctttgtgttcctaggcccacaaagtctttggtctgaagactcagagcttaaattgcattggtcctgttaatctttgtcaaaaaggaagtttgggcggcagtttcagggtagtgttgagaagataactcctggtcccattttattctttcctcatttgttcagtgctcatggccatctacaaccttccttgattctattctgcctaagcctcttatttccacatctataagtatagtgctacataataattacaacctttaagaaaatggagagttttcattaaagggcccctgcaaatctatgatgctagatgacagattctaccagaaggccagagtattaatagcacccgtgataactgtaataagaatatgtctcgttttcttttaaagacatagatattccattttaatcctgtataactcaaagaaaatttgggtgttaacactttgaaatacctttacctcctttgggggaaatccaaactgaaaggaattaatatccacatcagttcctaaagcaaaatgcctgacacagactaacaaagctctttctcatcctgtggtaggaacttaggagtgataactcacattgagaacttgtgatctgaaagcactaaggaatttctgccattgcaggtaggaaaaaaaaagacaaaaatggtattctcaggtgagcttacctttcaaatttttctgagacttcctaaatgtgacaagaactctgctgtgtggcaaccttatgtatccacaacagaactaaggaccgaaaaaaaaaaaaaaaagatctctatcccaatagattttataaaatccatactctaaaactcctgagttttacatgtaccctaaaacttaaagtatagtaaaaaaaagaaaagaaagaaaaactctttaaccctttgtttaaatcctattaactcttaacgatacacagttcgaattatctaaatgaaataattttcaagcacataacagattagaaacagagaatgagaaaggtatagtagatattatgtaaataagcagaaataatggcaataattaaacacactatctctacctaaaagaacagagatagaaaactcatataaaaatctaaactacagttttatggggatagttaaggtaagagcctgcaggcagcactgtattgctttacaaaacagcatttcatttgtattatgatgatttcagactatcaatttaaaaattcattagtataaattaagaacaggtaccattttctccagatacttccccttcatctgtcctgaaattattaattattgacttctacttaaataagatcttattttcatctgctggaaaactttttctgataaccatacatatcttcaatgtctacaatttgaatggagagccctttcaatgtggcgtttctgtttcttccataacctcacaacgatatgtggtggccccgcagtcattatggtcttgttaaataattagatttgtgtaaactatattttagagtcttccaaaacgcctctccttccaaaatggctaaaagggcaaagcgtcagtaattctgtagacatgcttcatgcatgttctgaataggagctatggtataatgagatgctatctctggaaaaaaatgaatagattttcaagattgtgagtcctgacatgagttctctagaattttcccctttgataaattttcctttacctagctgttgccaaattgtctcttctagaagaatgcccagattttttttcagttccaaagttatcaaaatcccaggaatatttcacagaaaagagaagcatttatagcaagcatgggtgtggcatgctttctctgtgggaagttgtcatcctccacaagatcttgcccacactcaaaacaaacttgcttcccatcacattcttggtttgtcagcactctgtaaaaggaaatctcatctcctgtctgttgatagtagagcttatatcaaactgggacatgtttcttcttcattcatgaataagtctaattttctctccggtgtgtaaaactgacaatacccacaagatactactgacttggaagtttcactgcaggtagctaccataccagcatttggtaaactagctccctaggtgagacagcattagatgacctccttcgtgccacactacttgccagtatccactgggagacaaattatgattgttgcgtccttctttgaaaacacccctgctgagtacctactgtatgtgagtcactgtgcaggcactagaaatataaagcaaaaaaaacagattctacccaccgggagctcctagtccagtggtgaagaggtgtattaaccctcaaggccctaagaaaatccccaatagggctctgcacaagccgggctctgataggaggtgccagtgcttttcttcttccagtttcagagccccagcgatcccaggatgaaggagagcccatttgcaaccctcttctgtctccctaagcattcaacaaacacttagtgaccatctgtcttgtgcaaaaagcttggggagtgataaaaacaaatcaaattcacattttaatttagggagtttaggagatacatcctagtgtggatttcacatggtcaatgatttgctttccttgaatttgccctctgcaaccaacacctgttcgtgctatgagactgaagtcctcctagaccgccccattcatctgagtagttagggctctggatgaaggagcaaatggacaaaataagccccctcttgctcaggacctgactaacatttcagaactgcggtcacccattttatacaaaccaaagcacttctgacagacctctgaatttgcattaaaaagagcacgtctacagctcctaacaatcaaaaacaactatgaacactgcttgcttcagtgatacaaacagacattttcttgttacatgtgtggtgatctgagaatggtgactttggacccagtttgactggttagcgtttaaataaaacttaacagactaggcaactaaaggaactcagtaaaagatcaaaagcaatgctcaaagggagtgcctgggtaaccatgatgtaattgcagattgacacatctttgggtttttcattattgtttctaaaaactagatattattgctttattattatgttgatgatgattattgaaagcacgatagcaatgtttaagtggtgagaatgactctaagcctctttttgttgctgtgactgacagaactaaagggagtttgctctcacattcacaataccaactctgccatcttatggaaaatattggaagtacctagggcatttcattatatttcaaaggcacaggttgctggtaagagggacagaaagacaagaacatagtaccttctatttctactacatgtttttaatctttaacatttttaccagcagaaatcattttttttttaaatctctcaatcttcaaataattcttagattgcttgccagcaaagatgtctcttgatcttgacactggaattcaatgtaaaaatcttgaatgatattttgtactgatatgaatttctactgtcccataacactgtgtagtgacttcactgtatattaacttcttttctacagatgtttgacttatgagatgaattaattgaaaaagtcaaagcctatcaggagctatcttatatgatgttggtagcctgtgaaaaaataaatgtcttttttcttatacaaactgataacaagacttgctttcacaattactatttacatttttgtgcatataatgcctgtatattatactcatatttgaaagtgatcagaaagtgttatttaacagaaactacatacattttttatgtctctctggaccctttgattctaagtaaatttacagtaagttagcagtaatagactattcttttcaactatgaataaaaatgtacactgaagtacaagatgactactgtttttaatacattttctcactatattatatatttattgtagtaaacttagaaaccatatgcatcttgaatgttcctgaattcttcagattttggaggattacccccctatttcatgcacaaataaaagtcttaagctacatgactataggaaacctggtccctcccctagaaatttctgagcaaccctggagagcgtttaaatgttctgcaagtgtacccaggtgatgccactgcccactgcagacagctgctctgggcttccccaccaatgcccctgactccaattacatctcacccctgccactcactccaccctgcctcttcccaaaacaggaactcggcctctcttttgattccacaagcaaagttgaaacaaacctttgtaactaacaagtgttactaaggttttgtggtaaatatactccagaaaagaaaaccttaaagtaggtctcaggtaccaatgagtccagagacattctgaatccaccttcacaggctggtctccatcagactcttcttgctcccctgcctctatcttgttgctcccaaggagatctgcccacttttgacttcttcattgcctctgagacaggtcatcaaaacatcctccaccacaacccagccagggagtaaaatccccttaacatgagagtactgtagtctccacaaaaattatttaaaagaacactttattctttacattatttgacagaacatttaacatctgacctgagtcatttgcactgggattccatccccagatcagactttcccaaaaacagtgagtgaatttgtcttgaacaaattgctagcacctcacagtgcattcatcacagaaaaaaaaaaaaagggaggagcctgttaacttttatgggaactttctgtattgcttttgcaactttttgtagttctacaactttatttaaaaggaagcagggaggcttgttttagtgacatactccagattctactcttagagatgaaagcacaacaacataaaaattcatacttttttttccatttccatttatcaaagtagaaatatagtctagtctcagagtgtctatctacttacaagccaaattttaagaagaaaagtttacattgctgatatgactgccttttcccttggatgaggatttgaattcctatgcctcgttggacaaatggaaatcatattgtatggcagacacatttcatagcaacaacttaagcataccctaagaatgaccctatggtttaagaagaatgtgtatttggagatctgtgctaaagaatccaggagtggctaacccggagattcatctcttatctataaggaacatctgagcccctagtccatcctgtggaacgcagcccattcaggagattgaggccctttgttttgggttaaacgaatgttgccaagtggatgttgctagcagaacagtgataagtgaaaatgtcatataaactgcatgctttttacaagtggttgcagtcctcctctccagcccactatcactggactgccccatatgtaagttccctcaataaactctgtgtctcattcactggcttcaggtctcttattcagcctctcaaacatggtgccctccctaccaaagtgaatgacatcaagcacgacacatattagatgttcctataatctaatcatagctatgatttaaactacagactagtatatattatttttcttctctttcatcttttgcctgtgtcacaataacttaatcatgtctttgctcctcctctgcaatctcactgccattgcatttattatggtactctttattaaatagtctcttcatggagcttagaccctcccccatcccccaaaactctgcttttcagtattatatttctaaagtaagaaatctgagccgtgttttatcaccctgcttaaaatcttgaaataggataaagactcagatccaaatttctcatcttggtatataaactcatccattatctgacccaacataggttatcagccttgtctcttacacacaacgtgtttttttcttgctcttatctaaacattgcccctgctctttcatgcttatatgatttgggagctcttcatgtataatggttatatcatcttgaatgctagatatatttccacattgtttaagacctaagttcaattatgtcctactaaaagtgcactcaatatataattattggctgcgtgtggtagctcatgcctataatcccagcactttgggaggccgaggtggctgaatcgcttgagttcaggagtttaagattaacctggccaacatgacaagaccacgtatctactaaaaatacaaaaaaaaacatcaactgggtgtggtggctggcgtgtgcctgtaattctacttgagaggctgaggcatgagaatcacttgattcttggagaatcacagctgcttgggaggctgaggcatgagaacccttgaattcaggaggtggagtatattaggctgttttcacactgctaataaagacctacctgagactgggtaatttataaaaaataagaggtttaatggactcacagttccacatgactgaggaggcctcacaatcatgacagaaggcaaaggaggagcaaaggcacgtcttacatagcagcagggaagagatcatgtccaggggaactctcccttacaaaaccatcagatatcatgagactaatttactatcatgagcacagcatgtgacagacctcccccccatgattcaataacctcccactgggtccctcctataacacatgggaattatgacagctacaattcaagatgagatttgggtggggaacacagccaaaccatatcattctgccgctgcccctcccaaatctcatgtcctcacatttcaaaacacagtcatgccttcccaacagtcccccaaagtcttaactcattacagcattaacacaaaatcccaactccagagtctcatctgagacaaggcaaatcccctctgcctatgagactgtaaaaatcaaaagcaagttagttactttctagatacaaggggagtacaggcattgggtaaatactcctgttctaaattggagaaattggcaaaaaccaaagggctataggccctatgcaagtctggaatccaatggggcagtcattaaaccttaaatttccaaaatgatctcctttgactccatgtctcacgtccaggtcacagtgatgcaagaggtgggctcccacagccttgggcagctccacttctgtggctttgcagggtacaacctccttcccagctgctttcatgggctggttatgagtgtctatggcttttccagatgcacagtgcaatctgtcagtgggtctaccattctggggtctgaaggatggtgaccctcttcttgaagctccactaggcagtgcctcagtgggcaccttgtgtgagggctccaaccccacatttgccttctccactgccctagcagagggtctccatgagggctccgcacctgcagcacacttctgcctggatatccaggtgtttccatacatcctctgaaatctagatggagattcccaaacctcagttcttgacttctatgcacccacaagctcaacaccacatggaagctgccaaggcttggggcttgcaccctctgaagccacagcctgagctgtaccttgtccccttttagccaaggctggagctgctggtaggcagggcaccaagtcccttggatgtacacagcaggtgggctttgggcccagcccaggaaaccatttgttccttctaggcctctgggcctgtgatgggaggggcagctatgaagatctctgacatgccctggagacatcttcctcattgtcttagtgattagcatttcagctcctcattacttatgcaaatttctgcagacagcttcaatttcttcccagaaaatggggttttcttttctatcacatcatcaggctgcaaatcttccaaacttttaggctctgcttcctcctgaatgcgtcaccgcttaaaaatttcttcccccagatatgctaaatcatctctttcaagttcagtgttccacagatctctaggacaggggcaaaatgccaccagtctctttactggagtaaagaacaacctttattccagttcccaacaagttccttatctccatctgagaccacctcagcctggactttatcatccatagcactatgagcattttggtcaaagacattcaacaaatttctaggaagttccaaactttctcacatcttcctttcttcttctgagccttccaaactgttccacctgttacccagttccaacatcacttccacattttcgggtacctttacagaggtgcaccaccatctggtaccaatttactgttttagtctgttctcactctactaataaagacatacctgagagtgggtaatttataaaaaataccaggtttaatgtactcacagttccatatggctggggagacatcataatcatggcagaaggcaaaggaggagcaaagtcatgtcttacatggtggcaaggaagagagcttgtgtagggtaactcccccttacaaagccatcagatctcatgagacttattcactatcacaagatcagcacatgaaagacccacccccatgattctataactcccacaacatgtgggaattatgggagctacaatctaagatgagatttgggtggggacacagccaagccaaatcacagagcttgcgatgagctgagatcatgccactgcactccaacagagggagactctgtctcgaaaaaacattttttaataaaaagaaaaatatgtatatatataattattgaacatttactctgtggaagatgttggttctacttggcagaattggtctttctacaccctaagaaatttagtattacttccattattagacattgaaccctaaatacacctatgacatcatgaattctctgagtgctttgtaaataggaatctaattagcttttttggcaatcacattaccttgttcattcccatcaaacctttctaacctggagccataaggttatcattccctgccctgcacacaaaggtaagtgttaagtaaaaattcctcatcttgtatctgctcaatgaatgtttagacttgatttcaggcacttatattgacttttattacacttaattttgtttgattcagcaaatcatttcaatctaataagatcaatttaaatgttgatattttaaaaatcaacttattttttattctcagattcatgtgatctgcaagtatgcaaacatctttttatccagatgctgcaaattattgaataagcaagaattagtaagatattatcaccaaattgtcacatcagtcaagcctcatgtgcttcctaagaactgaggtgatgcattattttagagtgtcattctaaaccccagattcaacatcttcctaatctttctagtgcagtctaatatataaattttatgaaaagcataggtttttttttaaccagcagtgctctttgagaatttacattgattcctaaagattgccattgctttgtataaaatgttataaattatcttagcatcttacctggaatttccactaaattcaccaatttatgatttgtgaaatctgattttactttttgaaaattttcatgtgaatttcccattttcagtgttgtagcacctctctcttcctctaagatcctgcaagctcatcaaaagccatgatcttattataccagcagttttatttattcaatctttcaacaagtagttattgaacttctataatgtgccaggctctggagctcgccttacaccaaacagacacaatcgatccattcgaagtgtcgtaattacacattgagggaccaactagaccttttctcattgtaaacttggagcaaaagtaaattcattaaaataaatttacattatagtgccacaaaaaaatgaacagaaccagaaagcattttttacaaaaattaacagaacagtgtgatagaggggaaaaggatgtgagatcatggtgccctaccttcaatagggtggccagaaaacacctctctgaagaagcagcatttgagctgagacctgaagaacgaggagtcagtgatgcagagaacctcaggagatgccttccaatctgagaaaaga
